(12) United States Patent
Arslan et al.

(10) Patent No.: US 11,859,241 B2
(45) Date of Patent: *Jan. 2, 2024

(54) COMPOSITIONS AND METHODS FOR PAIRWISE SEQUENCING

(71) Applicant: Element Biosciences, Inc., San Diego, CA (US)

(72) Inventors: Sinan Arslan, San Diego, CA (US); Junhua Zhao, San Diego, CA (US); Molly He, San Diego, CA (US); Samantha Snow, San Diego, CA (US); William Light, Poway, CA (US); Matthew Kellinger, San Diego, CA (US); Michael Previte, San Diego, CA (US); Michael Kim, El Cajon, CA (US); Hua Yu, San Diego, CA (US); Yu-Hsien Hwang-Fu, San Diego, CA (US); Marco Tjioe, San Diego, CA (US); Andrew Boddicker, San Diego, CA (US); Mark Ambroso, Escondido, CA (US); Tyler Lopez, Winchester, CA (US); Michael Klein, Encinitas, CA (US); Virginia Saade, San Diego, CA (US)

(73) Assignee: Element Biosciences, Inc., San Diego, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/166,429

(22) Filed: Feb. 8, 2023

(65) Prior Publication Data

US 2023/0203564 A1 Jun. 29, 2023

Related U.S. Application Data

(63) Continuation-in-part of application No. 17/521,239, filed on Nov. 8, 2021, which is a continuation of
(Continued)

(51) Int. Cl.
*C12Q 1/68* (2018.01)
*C12P 19/34* (2006.01)
(Continued)

(52) U.S. Cl.
CPC ......... *C12Q 1/6806* (2013.01); *C12Q 1/6834* (2013.01); *C12Q 1/6853* (2013.01);
(Continued)

(58) Field of Classification Search
CPC .................................................. C12Q 1/6869
See application file for complete search history.

(56) References Cited

U.S. PATENT DOCUMENTS 5,558,991 A 9/1996 Trainor
5,985,556 A 11/1999 Kambara et al.
(Continued)

FOREIGN PATENT DOCUMENTS

EP 1907573 B1 1/2010
WO WO-9844151 A1 10/1998
(Continued)

OTHER PUBLICATIONS

Bentley, et al., "Accurate whole human genome sequencing using reversible terminator chemistry." Nature, 2008, 456(7218):53-59.
(Continued)

*Primary Examiner* — Kenneth R Horlick
(74) *Attorney, Agent, or Firm* — COOLEY LLP; Heidi A. Erlacher; Edith Hang Yu Cheng

(57) ABSTRACT

The present disclosure provides compositions and methods that employ the compositions for conducting pairwise sequencing and for generating concatemer template molecules for pairwise sequencing. The concatemers can be generated using a rolling circle amplification reaction which is conducted either on-support, or conducted in-solution and then distributed onto a support. The rolling circle amplifi-
(Continued)

cation reaction generates concatemers containing tandem copies of a sequence of interest and at least one universal adaptor sequence. An increase in the number of tandem copies in a given concatemer increases the number of sites along the concatemer for hybridizing to multiple sequencing primers which serve as multiple initiation sites for polymerase-catalyzed sequencing reactions. When the sequencing reaction employs detectably labeled nucleotides and/or detectably labeled multivalent molecules (e.g., having nucleotide units), the signals emitted by the nucleotides or nucleotide units that participate in the parallel sequencing reactions along the concatemer yields an increased signal intensity for each concatemer.

25 Claims, 279 Drawing Sheets

Specification includes a Sequence Listing.

Related U.S. Application Data application No. 17/377,284, filed on Jul. 15, 2021, now Pat. No. 11,220,707.

(60) Provisional application No. 63/212,059, filed on Jun. 17, 2021.

(51) Int. Cl.
  *C12Q 1/6806* (2018.01)
  *C12Q 1/6834* (2018.01)
  *C12Q 1/6874* (2018.01)
  *G01N 21/64* (2006.01)
  *C12Q 1/6853* (2018.01)

(52) U.S. Cl.
  CPC ....... *C12Q 1/6874* (2013.01); *G01N 21/6428* (2013.01); *G01N 21/6458* (2013.01); *C12Q 2600/158* (2013.01)

(56) References Cited

U.S. PATENT DOCUMENTS

| | | | |
|---|---|---|---|
| 6,087,133 A | 7/2000 | Dattagupta et al. | |
| 6,284,497 B1 | 9/2001 | Sabanayagam et al. | |
| 7,211,390 B2 | 5/2007 | Rothberg et al. | |
| 7,244,559 B2 | 7/2007 | Rothberg et al. | |
| 7,264,929 B2 | 9/2007 | Rothberg et al. | |
| 7,566,537 B2 | 7/2009 | Balasubramanian et al. | |
| 7,709,197 B2 | 5/2010 | Drmanac | |
| 7,754,429 B2 | 7/2010 | Rigatti et al. | |
| 7,767,400 B2 | 8/2010 | Harris | |
| 7,897,344 B2 | 3/2011 | Dahl et al. | |
| 7,910,302 B2 | 3/2011 | Drmanac et al. | |
| 7,910,354 B2 | 3/2011 | Drmanac et al. | |
| 7,960,120 B2 | 6/2011 | Rigatti et al. | |
| 8,236,505 B2 | 8/2012 | Rigatti et al. | |
| 8,415,099 B2 | 4/2013 | Drmanac et al. | |
| 8,431,348 B2 | 4/2013 | Rigatti et al. | |
| 8,518,640 B2 | 8/2013 | Drmanac et al. | |
| 8,551,702 B2 | 10/2013 | Drmanac et al. | |
| 8,592,150 B2 | 11/2013 | Drmanac et al. | |
| 8,617,811 B2 | 12/2013 | Drmanac | |
| 8,765,379 B2 | 7/2014 | Drmanac | |
| 8,835,358 B2 | 9/2014 | Fodor et al. | |
| 8,951,731 B2 | 2/2015 | Drmanac et al. | |
| 9,023,769 B2 | 5/2015 | Drmanac et al. | |
| 9,029,103 B2 | 5/2015 | Rigatti et al. | |
| 9,222,132 B2 | 12/2015 | Drmanac | |
| 9,228,228 B2 | 1/2016 | Drmanac et al. | |
| 9,238,834 B2 | 1/2016 | Drmanac et al. | |
| 9,267,172 B2 | 2/2016 | Drmanac et al. | |
| 9,267,173 B2 | 2/2016 | Rigatti et al. | |
| 9,290,808 B2 | 3/2016 | Fodor et al. | |
| 9,290,809 B2 | 3/2016 | Fodor et al. | |
| 9,315,857 B2 | 4/2016 | Fu et al. | |
| 9,328,382 B2 | 5/2016 | Drmanac et al. | |
| 9,334,490 B2 | 5/2016 | Drmanac | |
| 9,476,054 B2 | 10/2016 | Drmanac et al. | |
| 9,567,645 B2 | 2/2017 | Fan et al. | |
| 9,567,646 B2 | 2/2017 | Fan et al. | |
| 9,582,877 B2 | 2/2017 | Fu et al. | |
| 9,598,736 B2 | 3/2017 | Fan et al. | |
| 9,624,489 B2 | 4/2017 | Sabot et al. | |
| 9,637,784 B2 | 5/2017 | Drmanac | |
| 9,637,785 B2 | 5/2017 | Drmanac | |
| 9,637,799 B2 | 5/2017 | Fan et al. | |
| 9,650,673 B2 | 5/2017 | Drmanac et al. | |
| 9,663,822 B2 | 5/2017 | Luo et al. | |
| 9,708,649 B2 | 7/2017 | Saito et al. | |
| 9,727,810 B2 | 8/2017 | Fodor et al. | |
| 9,816,137 B2 | 11/2017 | Fodor et al. | |
| 9,845,502 B2 | 12/2017 | Fodor et al. | |
| 9,905,005 B2 | 2/2018 | Fu et al. | |
| 9,944,984 B2 | 4/2018 | Drmanac et al. | |
| 9,994,541 B2 | 6/2018 | Batthyany et al. | |
| 10,002,316 B2 | 6/2018 | Fodor et al. | |
| 10,017,809 B2 | 7/2018 | Patel | |
| 10,036,059 B2 | 7/2018 | Zhang et al. | |
| 10,047,394 B2 | 8/2018 | Fodor et al. | |
| 10,059,991 B2 | 8/2018 | Fodor et al. | |
| 10,100,350 B2 | 10/2018 | Breslauer et al. | |
| 10,125,392 B2 | 11/2018 | Drmanac | |
| 10,131,958 B1 | 11/2018 | Fan et al. | |
| 10,151,003 B2 | 12/2018 | Fan et al. | |
| 10,202,641 B2 | 2/2019 | Shum | |
| 10,221,452 B2 | 3/2019 | Rigatti et al. | |
| 10,227,647 B2 | 3/2019 | Ke et al. | |
| 10,246,744 B2 | 4/2019 | Vijayan et al. | |
| 10,287,631 B2 | 5/2019 | Salk et al. | |
| 10,301,677 B2 | 5/2019 | Shum et al. | |
| 10,316,357 B2 | 6/2019 | Makarov et al. | |
| 10,329,613 B2 | 6/2019 | Rigatti et al. | |
| 10,344,329 B2 | 7/2019 | Hindson et al. | |
| 10,351,909 B2 | 7/2019 | Drmanac et al. | |
| 10,590,464 B2 | 3/2020 | Boutell et al. | |
| 10,689,699 B2 | 6/2020 | Salk et al. | |
| 10,704,094 B1 | 7/2020 | Arslan et al. | |
| 10,752,951 B2 | 8/2020 | Salk et al. | |
| 10,760,127 B2 | 9/2020 | Salk et al. | |
| 10,768,173 B1 | 9/2020 | Arslan et al. | |
| 10,876,148 B2 | 12/2020 | Zhou et al. | |
| 10,982,280 B2 | 4/2021 | Arslan et al. | |
| 11,118,225 B2 | 9/2021 | Salk et al. | |
| 11,124,842 B2 | 9/2021 | Bramlett et al. | |
| 11,130,996 B2 | 9/2021 | Salk et al. | |
| 11,174,509 B2 | 11/2021 | Link et al. | |
| 11,220,707 B1* | 1/2022 | Arslan | G01N 21/6458 |
| 11,236,388 B1* | 2/2022 | Arslan | G01N 21/6428 |
| 11,255,847 B2 | 2/2022 | Schnall-Levin | |
| 11,427,855 B1* | 8/2022 | Arslan | C12Q 1/6869 |
| 11,535,892 B1* | 12/2022 | Arslan | G01N 21/6428 |
| 2006/0024681 A1 | 2/2006 | Smith et al. | |
| 2006/0292611 A1 | 12/2006 | Berka et al. | |
| 2009/0247414 A1 | 10/2009 | Obradovic et al. | |
| 2011/0223601 A1 | 9/2011 | Rigatti et al. | |
| 2012/0156728 A1 | 6/2012 | Li et al. | |
| 2013/0012399 A1 | 1/2013 | Myers et al. | |
| 2013/0165350 A1 | 6/2013 | Kuimelis et al. | |
| 2013/0171631 A1 | 7/2013 | Becker et al. | |
| 2014/0206550 A1 | 7/2014 | Bjornson et al. | |
| 2014/0243242 A1 | 8/2014 | Nicol et al. | |
| 2018/0105871 A1 | 4/2018 | Korfhage et al. | |
| 2019/0292594 A1 | 9/2019 | Rigatti et al. | |
| 2020/0149095 A1 | 5/2020 | Arslan et al. | |
| 2020/0190578 A1 | 6/2020 | Boutell et al. | |
| 2020/0216899 A1 | 7/2020 | Arslan et al. | |
| 2020/0248258 A1 | 8/2020 | Arslan et al. | |
| 2020/0347443 A1 | 11/2020 | Arslan et al. | |
| 2021/0123098 A1 | 4/2021 | Previte et al. | |
| 2021/0189460 A1 | 6/2021 | Hosono et al. | |

(56) References Cited

U.S. PATENT DOCUMENTS

| | | | |
|---|---|---|---|
| 2021/0189483 A1* | 6/2021 | Drmanac | ............ C12Q 1/6874 |
| 2022/0403445 A1 | 12/2022 | Arslan et al. | |
| 2022/0403463 A1 | 12/2022 | Arslan et al. | |

FOREIGN PATENT DOCUMENTS

| WO | WO-0018957 A1 | 4/2000 |
|---|---|---|
| WO | WO-0075374 A1 | 12/2000 |
| WO | WO-2004070005 A2 | 8/2004 |
| WO | WO-2006084132 A2 | 8/2006 |
| WO | WO-2007010252 A1 | 1/2007 |
| WO | WO-2007010263 A2 | 1/2007 |
| WO | WO-2007091077 A1 | 8/2007 |
| WO | WO-2022015600 A2 | 1/2022 |
| WO | WO-2022087150 A2 | 4/2022 |
| WO | WO-2022094332 A1 | 5/2022 |
| WO | WO-2022266470 A1 | 12/2022 |

OTHER PUBLICATIONS

Bentley, "Whole-genome re-sequencing," Current Opinion in Genetics & Development, Dec. 2006, 16:545-552.

Eschenmoser, "Chemical Etiology of Nucleic Acid Structure," Science, Jun. 25, 1999, 284:2118-2124.

Ferrero and Gotor, "Biocatalytic Selective Modifications of Conventional Nucleosides, Carbocyclic Nucleosides, and C-Nucleosides," Chem. Rev., 2000, 100:4319-4347.

International Search Report and Written Opinion issued in PCT/US2022/034038, dated Oct. 13, 2022, 14 pages.

International Search Report and Written Opinion for International Application No. PCT/US2022/034038 dated Apr. 26, 2023, 16 pages.

Jeong, et al. "Structure-Activity Relationships of β-D-(2S, 5R)- and α-D-(2S, 5S)-I,3-Oxathiolanyl Nucleosides as Potential Anti-HIV Agents," J. Med. Chem., 1993, 36:2627-2638.

Kim, et al. "1,3-Dioxolanylpurine Nucleosides (2R,4R) and (2R,4S) with Selective Anti-HIV-1 Activity in Human Lymphocytes," J. Med. Chem., 1993, 36:30-37.

Martinez et al. "An allylic/acyclic adenosine nucleoside triphosphate for termination of DNA synthesis by DNA template-dependent polymerases," Nucleic Acids Research, 1999, 27(5):1271-1274.

Martinez et al. "Acyclic Nucleoside Triphosphate Analogs as Terminators in Biocatalytic DNA Replication," Bioorganic & Medicinal Chemistry Letters, 1997, 7(23):3013-3016.

New England Biolabs Certificate of Analysis and Safety Data Sheet, Product Name: Bst DNA Polymerase, Large Fragment, Catalog No. M0275S, Lot No. 10059774, Version 5, Nov. 25, 2019, 12 pages.

New England Biolabs Certificate of Analysis and Safety Data Sheet, Product Name: Bsu DNA Polymerase, Large Fragment, Catalog No. M0330S, Lot No. 10079279, Version 5, Nov. 25, 2019, 11 pages.

New England Biolabs Certificate of Analysis and Safety Data Sheet, Product Name: CutSmart® Buffer, Catalog No. B7204S, Lot No. 10095450, Version 6, Nov. 25, 2019, 10 pages.

New England Biolabs Certificate of Analysis and Safety Data Sheet, Product Name: DNA Polymerase I (*E. coli*), Catalog No. M0209S, Lot No. 10077358, Version 5, Nov. 25, 2019, 10 pages.

New England Biolabs Certificate of Analysis and Safety Data Sheet, Product Name: EpiMark® Hot Start Taq DNA Polymerase, Catalog No. M0490S, Lot No. 10053523, Version 5, Nov. 25, 2019, 11 pages.

New England Biolabs Certificate of Analysis and Safety Data Sheet, Product Name: LongAmp® Taq DNA Polymerase, Catalog No. M0323S, Lot No. 10048011, Nov. 25, 2019, 10 pages.

New England Biolabs Certificate of Analysis and Safety Data Sheet, Product Name: OneTaq® DNA Polymerase, Catalog No. M0480S, Lot No. 10056671, Version 5, Nov. 25, 2019, 10 pages.

New England Biolabs Certificate of Analysis and Safety Data Sheet, Product Name: phi29 DNA Polymerase, Catalog No. M0269S, Lot No. 10065462, Version 5, Nov. 25, 2019, 10 pages.

New England Biolabs Certificate of Analysis and Safety Data Sheet, Product Name: Q5U™ Hot Start High-Fidelity DNA Polymerase, Catalog No. M0515S, Lot No. 10048784, Version 2, Nov. 25, 2019, 11 pages.

New England Biolabs Certificate of Analysis and Safety Data Sheet, Product Name: T7 Exonuclease, Catalog No. M0263S, Lot No. 10045960, Version 5, Nov. 25, 2019, 10 pages.

New England Biolabs Certificate of Analysis and Safety Data Sheet, Product Name: Therminator™ DNA Polymerase, Catalog No. M0261S, Lot No. 10026393, Version 5, Nov. 25, 2019, 11 pages.

New England Biolabs Certificate of Analysis and Safety Data Sheet, Product Name: Thermolabile User® II Enzyme, Catalog No. M5508S, Lot No. 10066485, Version 2, Nov. 25, 2019, 11 pages.

* cited by examiner

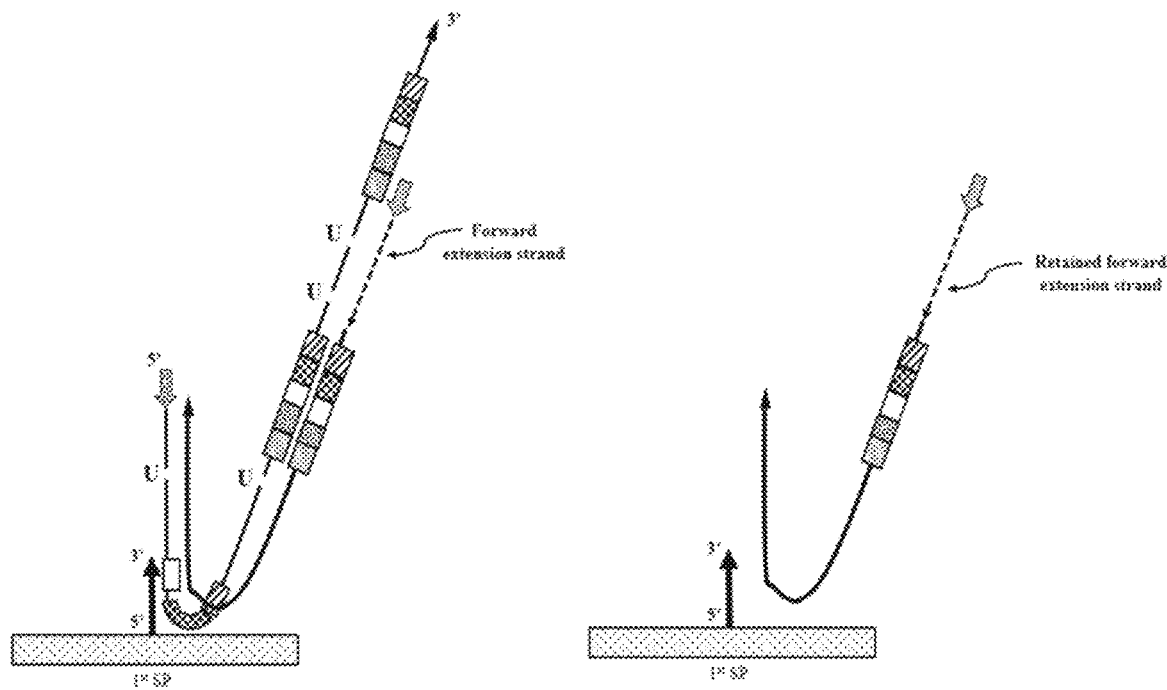
FIG. 46
FIG. 47
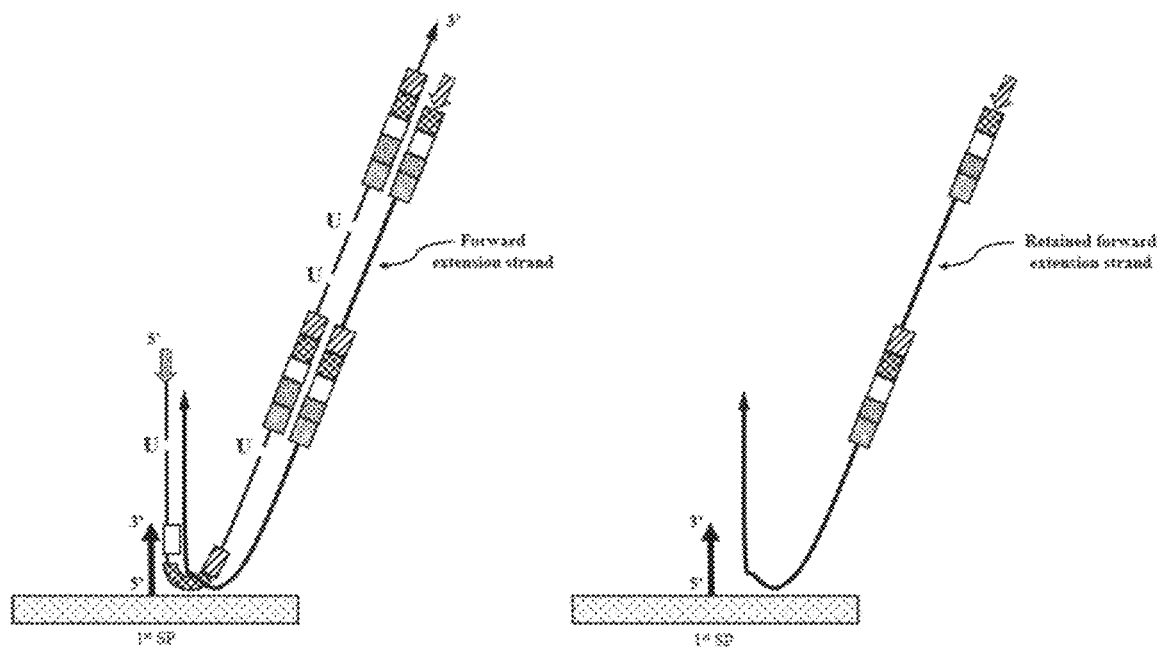
FIG. 48
FIG. 49

= 1st soluble amplification primer

= 1st soluble amplf'n primer binding site

= 1st surface primer binding site

= forward seq'g primer binding site

= reverse seq'g primer binding site

= 2nd soluble amplification primer binding site

Spacer: 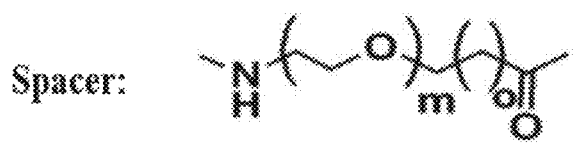
Linkers:
11 atom Linker: 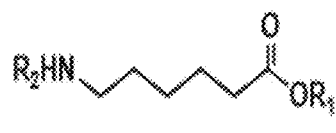
16 atom Linker: 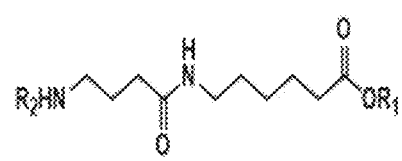
23 atom Linker: 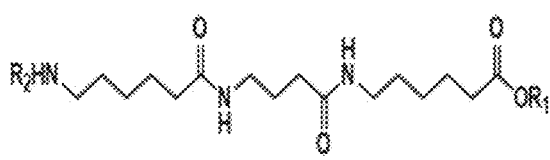
N3 Linker: 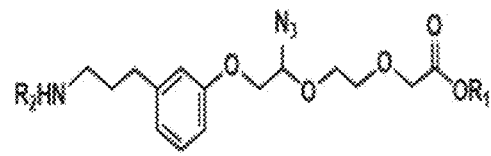
FIG. 109

Linker 1:
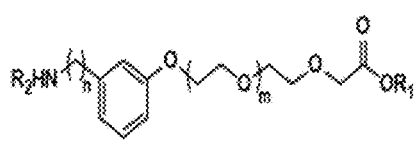
Linker 2:
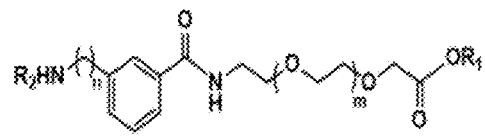
Linker 3:
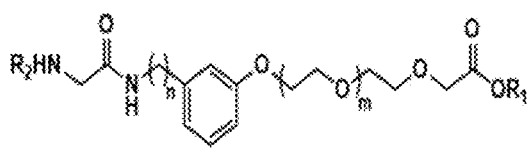
Linker 4:
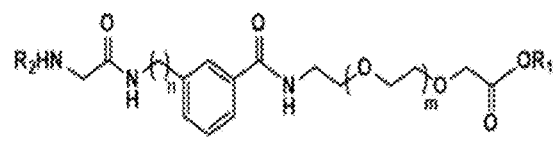
Linker 5:
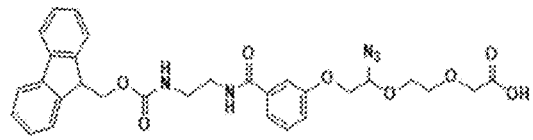
Linker 6:
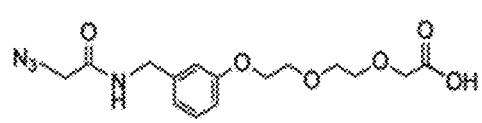
Molecular Weight: 352.35
Linker 7:
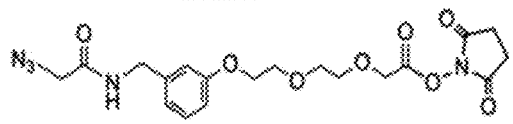
Molecular Weight: 449.42
Linker 8:
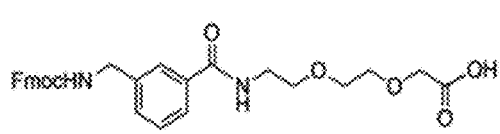
Molecular Weight: 518.57
Linker 9:
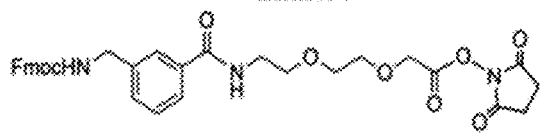
Molecular Weight: 615.64
FIG. 110 dNTP-PA-NH₂:
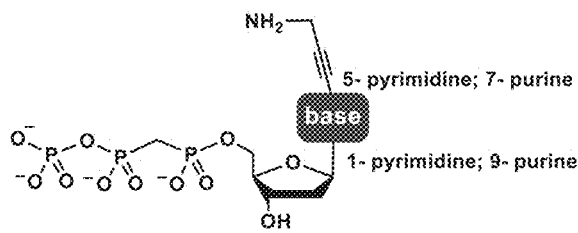
dNTP-PA-11 Atom Linker-NH₂:
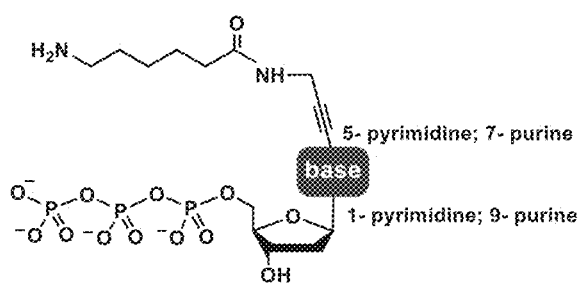
dNTP-PA-16 Atom Linker-NH₂:
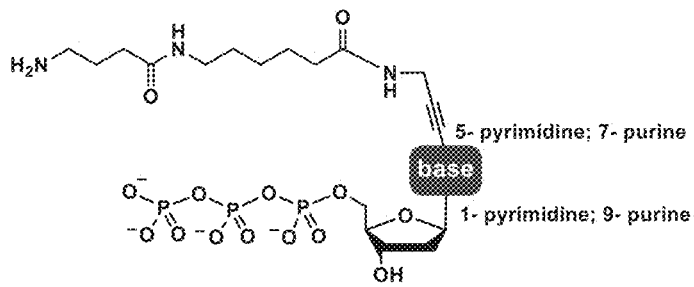
dNTP-PA-23 Atom Linker-NH₂:
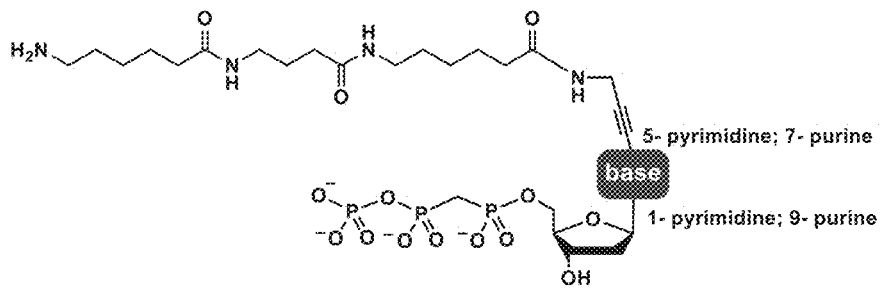
FIG. 111 dNTP-PA-N3 Linker-NH₂:
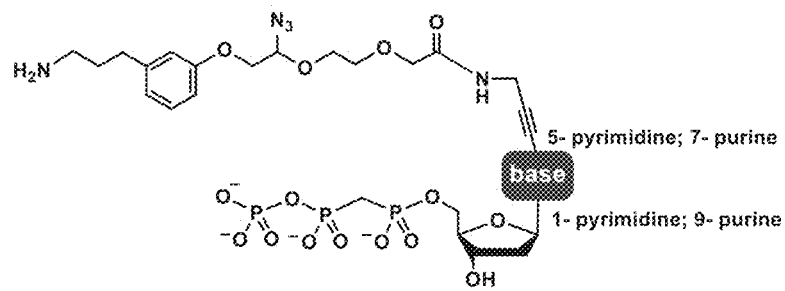
dNTP-PA-Linker 1-NH₂:
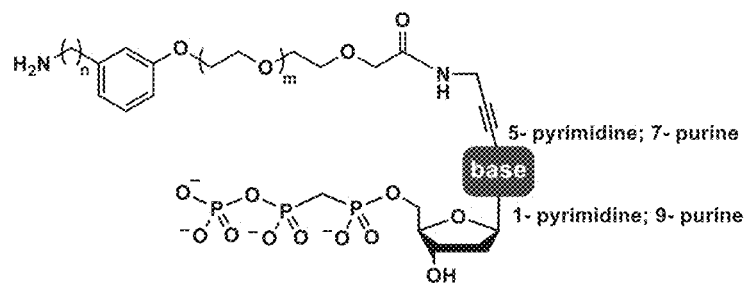
dNTP-PA-Linker 2-NH₂:
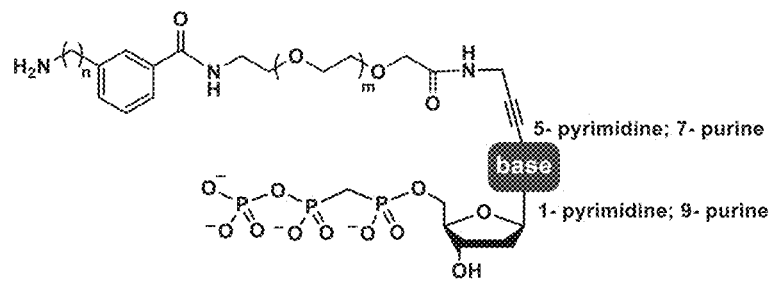
dNTP-PA-Linker 3-NH₂:
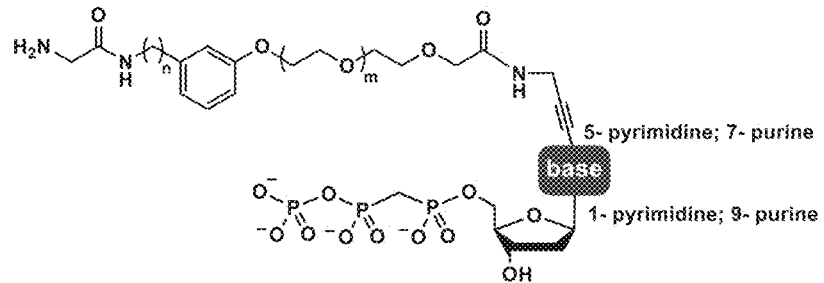
FIG. 112 dNTP-PA-Linker 4-NH₂:
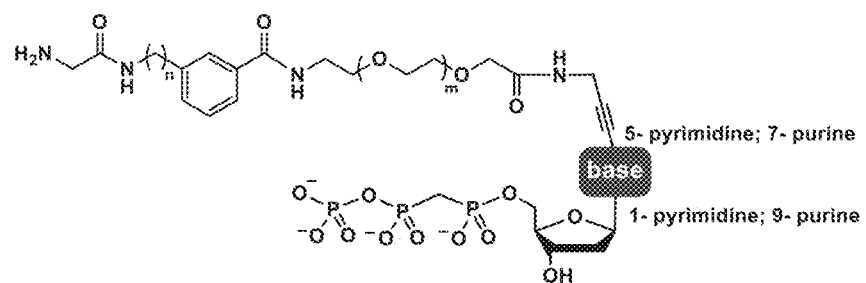
dNTP-PA-N3 Linker-NH₂:
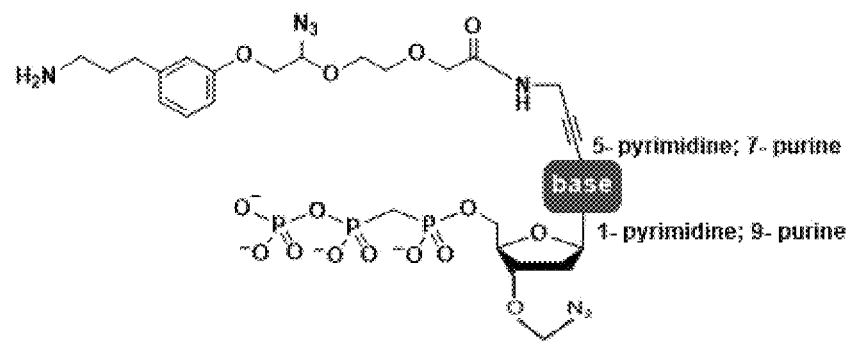
FIG. 113

G-tetrad

Wild type DNA polymerase from Thermococci archaeon
GenBank accession RLF 89458.1; isolate B13_G1 (SEQ ID NO:1)

MILDTDYITENGKPVIRIFKKEKGEFKIEYDRNFEPYIYALLEDDESIEDIKKITGERHG
KKVRIIRVEKVKKKFLGEPIEVWKLVFEHPQDVPAIRDAIRSHPAVREIFEYDIPFAKRY
LIDKGLVPMEGGEELKLLAFDIETFYHEGDEFAEGEILMISYADESGAKVITWKKIDLPY
VEVVSTEREAIKRFLQVLREKDPDVLLTYNGDNFDFAYIKKRCEKLGLKFTIGRDGSEPK
IQRMGDRFAVEVKGRIHLDLYPVVRHTIRLPTYTLEAVYEAVFGKKKEKVYAEEIAEAWK
SEEGLKRVAQYSMEDARATYELGREFFPMEVELAKLIGQSVWDVSRSSTGNLVEWYLLRV
AYERNELAPNKPGGEEYQRRMRSSYIGGYVKEPEKGLWESIAYLDFRSLYPSIIVTHNVS
PDTLEKECKNYDVAPIVGYRFCKDFKGFIPSILEDLIETRQKVKRKMKATIDPIEKKMLD
YRQRALKILANSYYGYQGYPKARWYSKECAESVTAWGRHYIETTIKEAEKFGFKVLYADT
DGFFATIPNEKPETIKSKAKKFLKHINEKLPGMLELEYEGFYLRGFFVTKKKYALIDEDG
HITTRGLEVVRRDWSEIAKETQAKVLEVILREGSIEKAAGIVKKVVEDLANYRVPVEKLI
IHEQITRELKDYKATGPHVAIAKRLQARGIKVKPGTIISYVVLKGSKKISDRVILFDEYD
SSRHKYDPDYYIHNQVLPAVLRILEAFGYKEKDLEYQRMKQTGLGAWLKMGKK

FIG. 120

Wild type DNA polymerase from Thermococci archaeon
GenBank accession RLF 78286.1; isolate B89_G9 (SEQ ID NO:2)

MILDTDYITENGKPVIRIFKKEKGEFKIEYDRNFEPYIYALLEDDESIEDIKKITGERHG
KKVRIIRVEKVKKKFLGEPIEVWKLVFEHPQDVPAIRDAIRSHPAVREIFEYDIPFAKRY
LIDKGLVPMEGGEELKLLAFDIETFYHEGDEFAEGEILMISYADESGAKVITWKKIDLPY
VEVVSTEREAIKRFLQVLREKDPDVLLTYNGDNFDFAYIKKRCEKLGLKFTIGREGSEPK
IQRMGDRFAVEVKGRIHLDLYPVVRHTIRLPTYTLEAVYEAVFGKKKEKVYAEEIAEAWK
SEEGLKRVAQYSMEDARATYELGREFFPMEVELAKLIGQSVWDVSRSSTGNLVEWYLLRV
AYERNELAPNKPGGEEYQRRMRSSYIGGYVKEPEKGLWESIAYLDFRSLYPSIIVTHNVS
PDTLEKECKNYDVAPIVGYRFCKDFKGFIPSILEDLIETRQKVKRKMKATIDPIEKKMLD
YRQRALKILANSYYGYQGYPKARWYSKECAESVTAWGRHYIETTIKEAEKFGFKVLYADT
DGFFATIPNEKPETIKSKAKKFLKHINEKLPGMLELEYEGFYLRGFFVTKKKYALIDEDG
HITTRGLEVVRRDWSEIAKETQAKVLEVILREGSIEKAAGIVKKVVEDLANYRVPVEKLI
IHEQITRELKDYKATGPHVAIAKRLQARGIKVKPGTIISYVVLKGSKKISDRVILFDEYD
SSRHKYDPDYYIHNQVLPAVLRILEAFGYKEKDLEYQRMKQTGLGAWLKMGKK

FIG. 121

Wild type DNA polymerase from Euryarchaeota archaeon
GenBank accession NOZ 58130; isolate M_MaxBin.100 (SEQ ID NO:1316)

MPRILKGFLIDADYETVEGRALIRLFLRGEEGSFVVYDDSFSPYFYALPGDEPERVKERI
LASGAAEAIQKVEIEEKRLFGTPRVALRITVSHPQDVPRIRERIRRVEGVDLILEHDILF
VRRYLIDRGIKPLTWLRLEVEERDGRALLRGVEQLEEEPPELRVAAVDIEVYNPKGAPRS
SKDEIIMISVATSDGVEKVLTWREVQGLEQVEVLQDEKEMLLRFAELIKEGDYDVIVGYN
TDSFDFPYIRDRLKKLGISLPGRLDAELEVSRRGALPEARIRGRAHVDLYPIVRRHVKL
NSYVLESVVEELLGIKKEKLDGERLFTYWDEGGEKRALLARYALEDARVTLALAEKFLPL
YCELSTIVGQSLNDVARMTSGQLVEWLLMRYATPRGELIPNHPAGEEYAARARATYAGGY
VREPKRGLVEHIAVFDFRSLYPSIIVSHNIDPSTLIVGNCEENRAPELEYCFSLEREGFI
PAILKELIRRRAEIKRELKRSEGDRRRTLSFAEKALKILANSFYGYMGYPRARWYRRECA
ESVAAFARMYIKQVMRIAEEEFKLEVVYGDTDSLFVVIPPEKRELAQKFLQKVNESMPGI
IELEFEGFYRRGLFVTKKRYALLSEDGKMVVKGLEFVRRDWAPIARETQKEVLRILLEEA
DPEKAARLVRDVIERIRQRRVSLEDITIYTQLTKRIKSYKSLEPHVVAAQKLKERGREVA
PGMIIGYIITKGTKGISQRATPVEFARLEDYDPEYYIDNQILPAIQRIFEAIGYTRDYLK
EGITQTSLSRWF

FIG. 122

Wild type DNA polymerase from Euryarchaeota archaeon
GenBank accession RMF 90817.1; isolate J060 (SEQ ID NO:2215)

MARDLLLDIDYVTVDEKAQVRLFLKDKILFDPGFQPYFYVLAHDGAVEERLRDFGAVEAV
QRRMLGREMRFFKLILSHPSEVPKIREEVRSIEGVEGIFEHDILFARRYLIDKGLTPLNY
AEYRAEQGFLKGISSAGEGPESLRVMAFDIETYNPKGAPRAEKDPVIMLSLSTNTGLRRL
LTYKSGEGLDFVELVEDEKALLHRFKELVNEEGVEVLVGYNSDQFDLPYLVARAKALGVE
LPLGQDGSQPQIRKGRGLVESVVKGRPHVDLYPIVRRNVRLSSYVLENVVKEVLGREKEK
IPHDAMCGYWDRGGRELQRFMAYSMEDADVTLELAERFLPLYIELSRVVGLPLHDVARMT
AGQLVEWLLIREAFARGEVVPNKGSGREYLARSEDTYAGGYVMEPVKGIVENIVVFDFRS
LYPSIIVTHNIDPATLRPGRGENSPPELDYHFTTEEEGFIPSVLKRVLERRLSAKRRMKE
ARDPGEKRMLDISQRALKIIANSFYGYMGYPRARWYKKECAESVTSFARMYTKKVMAIAE
EEYGFKVVYGDTDSLFIVVQPEEKERAMSFMEDVNRRLPGTVELEYDGFYPRGIFITKKR
YALIDEKGNIVVKGLETVRRDWTRLSRDTQQKVLSVILREGDPKKAADIVKDTINRLKER
RVDLEDITIYTQLTKGIGRYKNVGPHVKAAQKAIDRGREVNPGMAIGYIIKKGRGLISDR
AEPVEDATIEDYDVDYYIENQVLPPVARIMEVLGYSKEHLKEEMVQGSLQRWF

FIG. 123

Wild type DNA polymerase from Hadesarchaea archaeon
GenBank accession MBC 7218772.1; isolate MAG-18 (SEQ ID NO:2367)

MRGLLFDVDIAEEEERPNVRLFVKVASETVVAIDPQFEEYFYVVADHPAKTSKLIEKIEL
DEGGRPIRPKSVEMVRRTLLGNEVEAIRVSFHQPRDAAKLRHKIRELPGVKEIYEFDIPP
ARRYLIDRGLTPMAGIEFSGSIEVRDGVKTVVMDGPPKPAPVEETRLNIMSFDIEVYNPT
GSVRPDKPIIMISLADNRGLRKVITWKNFDKKPEYVEVVGSEREMIKKFVELVKERDVD
ILLGYNTDLFDLPYIRSRAKQLRVKLDLGRDGSELVVRKRRFATASKIRGRVHVDVFAMV
DFLATIGSIRLIHYSLADVYRHYAGREKPDFEFSEMINAWERGGDAGRRFLEYSMSDADA
TLEVGSELLPFLGLTRVVGQTLFDVQRMTPGQLVEWLLVAEAHRIGELVPPRPVGEEFE
ERAEGTFTGAYVMEPVKGLHEDLVVFDFRSLYPSIIVTHNIDPSTLNCRDCKPGEREQVP
GLSYYFCKRRKGFIPAVLERVIEERTKLKAELKKIGRETREYRALDARQWAMKIVANSFY
GMLGYPRARWYSKQCAESVTSFGRHYIHRTIEMAREFGLEVVYGDTDSLHCKLNGKTREE
AMVFLRKVNESLPGIMELELEGFYPRGIFITKKRYAMVDDEGRMVVKGLEFVRRDWAAIA
KKTQEEVLRAILRDGSPKKAAEIIRKTTRDVYEGRVNLEDLIIYTQLKMPIESYKAIGPH
VVAAKRLRELGHEIEPGMMIAYIEVKGPGSISDRAVPVEDFEGKEYDPDYYVGHQILPAV
MRIMEVLGYSEEDLKFEREKQIGLDRFMK

FIG. 124

Wild type DNA polymerase from Thermococcus sp. 2319x1
GenBank accession WP 175059460.1 (SEQ ID NO:2393)

MILDTDYITKDGKPIIRIFKKENGEFKIELDPHFQPYIYALLKDDSAIEEIKAIKGERHG
KTVRVLDAVKVRKKFLGREVEVWKLIFEHPQDVPAMRDKIKEHPAVIDIYEYDIPFAKRY
LIDKGLIPMEGDEELKLLAFDIETFYHEGDEFGKGEIIMISYADEEEARVITWKNIDLPY
VDVVSNEREMIKRFVQVVKEKDPDVIITYNGDNFDLPYLIKRAEKLGIRLVLGRDKENPE
PKIQRMGDSFAVEIKGRIHFDLFPVVRRTINLPTYTLEAVYEAVLGKTKSKLGAEEIAAI
WETEESMKKLAQYSMEDARATYELGKEFFPMEAELAKLIGQSVWDVSRSSTGNLVEWYLL
RVAYARNELAPNKPDEEEYKRRLRTTYLGGYVKEPEKGLWENIIYLDFRSLYPSIIVTHN
VSPDTLEKEGCENYDIAPIVGYKFCKDFPGFIPSILGDLIAMRQEIKKKMKATIDPIEKK
MLDYRQRAVKLLANSYYGYMGYPKARWYSKECAESVTAWGRHYIEMTIKEIEEKFGFKVL
YADTDGFYATIPGEKPEIIKKKAREFLNYINSKLPGLLELEYEGFYLRGFFVTKKRYAVI
DEEGRITTRGLEVVRRDWSEIAKETQAKVLEAILKDGSVEKAVEIVRDVVEKIAKYRVPL
EKLVIHEQITRDLKDYKAIGPHVSIAKRLATRGIKVKPGTTISYLVLKGGGRISDRVILL
TEYDPEKHKYDPDYYIENQVLPAVLRILEAFGYRKEDLRYQSSKQTGLDAWLKR

FIG. 125

Wild type DNA polymerase from Candidatus Hadarchaeum yellowstonense
GenBank accession KUO 42443.1; isolate YNP_45 (SEQ ID NO:2408)

MLLDVDYAEEEEKPSIRLFVKTGSEVLVAIDPDFEEYFYVVSDHPAKASKLIEKVEVEED
GVSIRPKGVEIVKRTFLGNEVEAIKVSFYQAKDSSKLRHKIRELPGVREIYEFDIPPARR
YLIDRGLTPMAGVEFDGRIEERQGIKTVILDSPPRPAQVEEPKLNIMSFDIEVYNPTGSV
RPDKDPIIMISLADNNGLRKVITWKNFERSQEYVEVVGSEREMIKRFVDLVKERDVDILL
GYNTDLFDLPYIRSRAKQLKVKLDLGRDGSELVVRKRRFATASKIRGRIHVDFAMVDFL
ATIGSIKLIHYSLADVYRHLLGKEKPDFEFTEMVDAWEKGGDAGRKFLEYSMSDADATLE
VGLELLPLFLGLTRVVGQTLFDVQRMTPGQLVEWLLVAEAHRIGELVPGRPVGEEYEERM
EETFVGAYVMEPVKGLHENLVVFDFRSLYPSIIVTHNIDPSTLNCKDCKPGEREQVPGLE
YYFCRRRKGFIPATLQRIIEERMKLKAELKKLVRGTKEYRALDARQWAMKIVANSFYGML
GYPRARWYSKECAESVTSFGRHYIHKTIDMAREFGLEVVYGDTDSLHCKLNGKTREEALA
FLKKVNDSLPGIMELELEGFYPRGIFTTKKRYAMIDDEGRMVVKGLEFVRRDWAAIAKKT
QEEVLKAILRDGSPEKAAEIIRKTTRDVYEGRVNLEDLIIYTQLKMPIESYKAIGPHVVA
AKRLRELGHEIEPGMMIAYVEVKGPGSISERAVPVEDFKGREYDPDYYVGHQVLPAVMRI
MEVLGYREIDLKFERQRQVGLDRFMK

FIG. 126

Wild type DNA polymerase from Euryarchaeota archaeon
GenBank accession NOZ 77387.1; isolate M_MaxBin.027 (SEQ ID NO:2436)

MDGFLLDVDYKTVDEKPVVRLFLRDVIALDPSFRPYVYVACDDPRAVAGEIKDLELDGRR
PVTGVEEMERGLLGRPRRFLKVYLGHPQQVPRVRDLLRRLPGVSAVLEDDILFSRRYLID
KGLVPTAWVELQGRVEGSEFWVEEVRRAEGPLPRLKVMSFDIETYNPKGAPRGDQPIIM
VSMATSGGLRKVLSWKAPTAGLEFVETLEDEAAVLRRFEELVRQEDPDILVGYNTDNFDF
PYLNQRLKALGIELALGRDGSPHKTSTRMGMSETRMAGRPHMDLYPIVRRSLRLPSYVLE
DVVAEVLGEEKEKVPGERMGEIWDKGGEELDRFFRYSLEDAEVTLRIGEKYLPLYIELSR
LVGQSIHDVARMTAGQLVEWYLMREAFARGEVIPERPGGREFARRAGDTYEGGYVREPRK
GLLEKVFDFRSLYPSVIVTHNIDPSTIRPGPGENQPPGIDYHFTTEKEGFIPALLKRLVA
RRAELKEEMKKARDPGERKMLDVQQQALKILANSFYGYMGYPRARWYRKECAESVTAFAR
DYIKKVMEVAEKEFGLEVVYGDTDSLFILPGGKKERAFAFLEEVNRRLPGTIELEYEGF
YRRGIFVTKKRYALIDEKDRIIVKGLEFVRRDWAPIARDTQEKVLKALLKDASPEEAVRI
VRKAMDDIRARRVSLEDLTIYTQLTKK

FIG. 127

Wild type DNA polymerase from Geobacillus stearothermophilus (Bst polymerase) GenBank accession AAB52611.1 (SEQ ID NO:2502)

MKKKLVLIDGNSVAYRAFFALPLLHNDKGIHTNAVYGFTMMLNKILAEEQPTHLLVAFDA
GKTTFRHETFQEYKGGRQQTPPELSEQFPLLRELLKAYRIPAYELDHYEADDIIGTLAAR
AEQEGFEVKIISGDRDLTQLASRHVTVDITKKGITDIEPYTPETVREKYGLTPEQIVDLK
GLMGDKSDNIPGVPGIGEKTAVKLLKQFGTVENVLASIDEVKGEKLKENLRQHRDLALLS
KQLASICRDAPVELSLDDIVYEGQDREKVIALFKELGFQSFLEKMAAPAAEGEKPLEEME
FAIVDVITEEMLADKAALVVEVMEENYHDAPIVGIALVNEHGRFFMRPETALADSQFLAW
LADETKKKSMFDAKRAVVALKWKGIELRGVAFDLLLAAYLLNPAQDAGDIAAVAKMKQYE
AVRSDEAVYGKGVKRSLPDEQTLAEHLVRKAAAIWALEQPFMDDLRNNEQDQLLTKLEQP
LAAILAEMEFTGVNVDTKRLEQMGSELAEQLRAIEQRIYELAGQEFNINSPKQLGVILFE
KLQLPVLKKTKTGYSTSADVLEKLAPHHEIVENILHYRQLGKLQSTYIEGLLKVVRPDTG
KVHTMFNQALTQTGRLSSAEPNLQNIPIRLEEGRKIRQAFVPSEPDWLIFAADYSQIELR
VLAHIADDDNLIEAFQRDLDIHTKTAMDIFHVSEEEVTANMRRQAKAVNFGIVYGISDYG
LAQNLNITRKEAAEFIERYFASFPGVKQYMENIVQEAKQKGYVTTLLHRRRYLPDITSRN
FNVRSFAERTAMNTPIQGSAADIIKKAMIDLAARLKEEQLQARLLLQVHDELILEAPKEE
IERLCELVPEVMEQAVTLRVPLKVDYHGPTWYDAK

FIG. 128

9°N polymerase (SEQ ID NO:2503)

MILDTDYITENGKPVIRVFKKENGEFKIEYDRTFEPYFYALLKDDSAIEDVKKVTAKRHG
TVVKVKRAEKVQKKFLGRPIEVWKLYFNHPQDVPAIRDRIRAHPAVVDIYEYDIPFAKRY
LIDKGLIPAEGDEELTMLAFDIETLYHEGEEFGTGPILMISYADGSEARVITWKKIDLPY
VDVVSTEKEMIKRFLRVVREKDPDVLITYNGDNFDFAYLKKRCEELGIKFTLGRDGSEPK
IQRMGDRFAVEVKGRIHFDLYPVIRRTINLPTYTLEAVYEAVFGKPKEKVYAEEIAQAWE
SGEGLERVARYSMEDAKVTYELGREFFPMEAQLSRLIGQSLWDVSRSSTGNLVEWFLLRK
AYKRNELAPNKPDERELARRRGGYAGGYVKEPERGLWDNIVYLDFRSLYPSIIITHNVSP
DTLNREGCKEYDVAPEVGHKFCKDFPGFIPSLLGDLLEERQKIKRKMKATVDPLEKKLLD
YRQRAIKILANSFYGYYGYAKARWYCKECAESVTAWGREYIEMVIRELEEKFGFKVLYAD
TDGLHATIPGADAETVKKKAKEFLKYINPKLPGLLELEYEGFYVRGFFVTKKKYAVIDEE
GKITTRGLEIVRRDWSEIAKETQARVLEAILKHGDVEEAVRIVKEVTEKLSKYEVPPEKL
VIHEQITRDLRDYKATGPHVAVAKRLAARGVKIRPGTVISYIVLKGSGRIGDRAIPADEF
DPTKHRYDAEYYIENQVLPAVERILKAFGYRKEDLRYQKTKQVGLGAWLKVGKK

FIG. 129

9°N polymerase
UniProtKB - Q56366 (DPOL_THES9) (SEQ ID NO:2504)

MILDTDYITENGKPVIRVFKKENGEFKIEYDRTFEPYFYALLKDDSAIEDVKKVTAKRHG
TVVKVKRAEKVQKKFLGRPIEVWKLYFNHPQDVPAIRDRIRAHPAVVDIYEYDIPFAKRY
LIDKGLIPMEGDEELTMLAFDIETLYHEGEEFGTGPILMISYADGSEARVITWKKIDLPY
VDVVSTEKEMIKRFLRVVREKDPDVLITYNGDNFDFAYLKKRCEELGIKFTLGRDGSEPK
IQRMGDRFAVEVKGRIHFDLYPVIRRTINLPTYTLEAVYEAVFGKPKEKVYAEEIAQAWE
SGEGLERVARYSMEDAKVTYELGREFFPMEAQLSRLIGQSLWDVSRSSTGNLVEWFLLRK
AYKRNELAPNKPDERELARRRGGYAGGYVKEPERGLWDNIVYLDFRSLYPSIIITHNVSP
DTLNREGCKEYDVAPEVGHKFCKDFPGFIPSLLGDLLEERQKIKRKMKATVDPLEKKLLD
YRQRAIKILANSFYGYYGYAKARWYCKECAESVTAWGREYIEMVIRELEEKFGFKVLYAD
TDGLHATIPGADAETVKKKAKEFLKYINPKLPGLLELEYEGFYVRGFFVTKKKYAVIDEE
GKITTRGLEIVRRDWSEIAKETQARVLEAILKHGDVEEAVRIVKEVTEKLSKYEVPPEKL
VIHEQITRDLRDYKATGPHVAVAKRLAARGVKIRPGTVISYIVLKGSGRIGDRAIPADEF
DPTKHRYDAEYYIENQVLPAVERILKAFGYRKEDLRYQKTKQVGLGAWLKVKGKK

FIG. 130

Therminator polymerase (SEQ ID NO:2505)

MILDTDYITENGKPVIRVFKKENGEFKIEYDRTFEPYFYALLKDDSAIEDVKKVTAKRHG
TVVKVKRAEKVQKKFLGRPIEVWKLYFNHPQDVPAIRDRIRAHPAVVDIYEYDIPFAKRY
LIDKGLIPMEGDEELTMLAFAIATLYHEGEEFGTGPILMISYADGSEARVITWKKIDLPY
VDVVSTEKEMIKRFLRVVREKDPDVLITYNGDNFDFAYLKKRCEELGIKFTLGRDGSEPK
IQRMGDRFAVEVKGRIHFDLYPVIRRTINLPTYTLEAVYEAVFGKPKEKVYAEEIAQAWE
SGEGLERVARYSMEDAKVTYELGREFFPMEAQLSRLIGQSLWDVSRSSTGNLVEWFLLRK
AYKRNELAPNKPDERELARRRGGYAGGYVKEPERGLWDNIVYLDFRSLYPSIIITHNVSP
DTLNREGCKEYDVAPEVGHKFCKDFPGFIPSLLGDLLEERQKIKRKMKATVDPLEKKLLD
YRQRLIKILANSFYGYYGYAKARWYCKECAESVTAWGREYIEMVIRELEEKFGFKVLYAD
TDGLHATIPGADAETVKKKAKEFLKYINPKLPGLLELEYEGFYVRGFFVTKKKYAVIDEE
GKITTRGLEIVRRDWSEIAKETQARVLEAILKHGDVEEAVRIVKEVTEKLSKYEVPPEKL
VIHEQITRDLRDYKATGPHVAVAKRLAARGVKIRPGTVISYIVLKGSGRIGDRAIPADEF
DPTKHRYDAEYYIENQVLPAVERILKAFGYRKEDLRYQKTKQVGLGAWLKVKGKK

FIG. 131

Vent polymerase UniProtKB - P30317 (DPOL_THELI) (SEQ ID NO:2506)

```
MILDTDYITKDGKPIIRIFKKENGEFKIELDPHFQPYIYALLKDDSAIEEIKAIKGERHG
KTVRVLDAVKVRKKFLGREVEVWKLIFEHPQDVPAMRGKIREHPAVVDIYEYDIPFAKRY
LIDKGLIPMEGDEELKLLAFDIETFYHEGDEFGKGEIIMISYADEEEARVITWKNIDLPY
VDVVSNEREMIKRFVQVVKEKDPDVIITYNGDNFDLPYLIKRAEKLGVRLVLGRDKEHPE
PKIQRMGDSFAVEIKGRIHFDLFPVVRRTINLPTYTLEAVYEAVLGKTKSKLGAEEIAAI
WETEESMKKLAQYSMEDARATYELGKEFFPMEAELAKLIGQSVWDVSRSSTGNLVEWYLL
RVAYARNELAPNKPDEEEYKRRLRTTYLGGYVKEPEKGLWENIIYLDFRSLYPSIIVTHN
VSPDTLEKEGCKNYDVAPIVGYRFCKDFPGFIPSILGDLIAMRQDIKKKMKSTIDPIEKK
MLDYRQRAIKLLANSILPNEWLPIIENGEIKFVKIGEFINSYMEKQKENVKTVENTEVLE
VNNLFAFSFNKKIKESEVKKVKALIRHKYKGKAYEIQLSSGRKINITAGHSLFTVRNGEI
KEVSGDGIKEGDLIVAPKKIKLNEKGVSINIPELISDLSEEETADIVMTISAKGRKNFFK
GMLRTLRWMFGEENRRIRTFNRYLFHLEKLGLIKLLPRGYEVTDWERLKKYQLYEKLAG
SVKYNGNKREYLVMFNEIKDFISYFPQKELEEWKIGTLNGFRTNCILKVDEDFGKLLGYY
VSEGYAGAQKNKTGGISYSVKLYNEDPNVLESMKNVAEKFFGKVRVDRNCVSISKKMAYL
VMKCLCGALAENKRIPSVILTSPEPVRWSFLEAYFTGDGDIHPSKRFRLSTKSELLANQL
VFLLNSLGISSVKIGFDSGVYRVYINEDLQFPQTSREKNTYYSNLIPKEILRDVFGKEFQ
KNMTFKKFKELVDSGKLNREKAKLLEFFINGDIVLDRVKSVKEKDYEGYVYDLSVEDNEN
FLVGFGLLYAHNSYYGYMGYPKARWYSKECAESVTAWGRHYIEMTIREIEEKFGFKVLYA
DSVSGESEIIRQNGKIRFVKIKDLFSKVDYSIGEKEYCILEGVEALTLDDDGKLVWKPV
PYVMRHRANKRMFRIWLTNSWYIDVTEDHSLIGYLNTSKTKTAKKIGERLKEVKPFELGK
AVKSLICPNAPLKDENTKTSEIAVKFWELVGLIVGDGNWGGDSRWAEYYLGLSTGKDAEE
IKQKLLEPLKTYGVISNYYPKNEKGDFNILAKSLVKFMKRHFKDEKGRRKIPEFMYELPV
TYIEAFLRGLFSADGTVTIRKGVPEIRLTNIDADFLREVRKLLWIVGISNSIFAETTPNR
YNGVSTGTYSKHLRIKNKWRFAERIGFLIERKQKRLLEHLKSARVKRNTIDFGFDLVHVK
KVEEIPYEGYVYDIEVEETHRFFANNILVHNTDGFYATIPGEKPELIKKKAKEFLNYINS
KLPGLLELEYEGFYLRGFFVTKKRYAVIDEEGRITTRGLEVVRRDWSEIAKETQAKVLEA
ILKEGSVEKAVEVVRDVVEKIAKYRVPLEKLVIHEQITRDLKDYKAIGPHVAIAKRLAAR
GIKVKPGTIISYIVLKGSGKISDRVILLTEYDPRKHKYDPDYYIENQVLPAVLRILEAFG
YRKEDLRYQSSKQTGLDAWLKR
```

FIG. 132

Deep Vent polymerase UniProtKB - Q51334 (DPOL_PYRSD) (SEQ ID NO:2507)

MILDADYITEDGKPIIRIFKKENGEFKVEYDRNFRPYIYALLKDDSQIDEVRKITAERHG
KIVRIIDAEKVRKKFLGRPIEVWRLYFEHPQDVPAIRDKIREHSAVIDIFEYDIPFAKRY
LIDKGLTPMEGDEELKLLAFDIETLYHEGEEFAKGPIIMISYADEEEAKVITWKKIDLPY
VEVVSSEREMIKRFLKVIREKDPDVIITYNGDSFDLPYLVKRAEKLGIKLPLGRDGSEPK
MQRLGDMTAVEIKGRIHFDLYHVIRRTINLPTYTLEAVYEAIFGKPKEKVYAHEIAEAWE
TGKGLERVAKYSMEDAKVTYELGREFFPMEAQLSRLVGQPLWDVSRSSTGNLVEWYLLRK
AYERNELAPNKPDEREYERRLRESYAGGYVKEPEKGLWEGLVSLDFRSLYPSIIITHNVS
PDTLNREGCREYDVAPEVGHKFCKDFPGFIPSLLKRLLDERQEIKRKMKASKDPIEKKML
DYRQRAIKILANSILPEEWVPLIKNGKVKIFRIGDFVDGLMKANQGKVKKTGDTEVLEVA
GIHAFSFDRKSKKARVMAVKAVIRHRYSGNVYRIVLNSGRKITITEGHSLFVYRNGDLVE
ATGEDVKIGDLLAVPRSVNLPEKRERLNIVELLLNLSPEETEDIILTIPVKGRKNFFKGM
LRTLRWIFGEEKRVRTASRYLRHLENLGYIRLRKIGYDIIDKEGLEKYRTLYEKLVDVVR
YNGNKREYLVEFNAVRDVISLMPEEELKEWRIGTRNGFRMGTFVDIDEDFAKLLGYYVSE
GSARKWKNQTGGWSYTVRLYNENDEVLDDMEHLAKKFFGKVKRGKNYVEIPKKMAYIIFE
SLCGTLAENKRVPEVIFTSSKGVRWAFLEGYFIGDGDVHPSKRVRLSTKSELLVNGLVLL
LNSLGVSAIKLGYDSGVYRVYVNEELKFTEYRKKKNVYHSHIVPKDILKETFGKVFQKNI
SYKKFRELVENGKLDREKAKRIEWLLNGDIVLDRVVEIKREYYDGYVYDLSVDEDENFLA
GFGFLYAHNSYYGYYGYAKARWYCKECAESVTAWGREYIEFVRKELEEKFGFKVLYIDTD
GLYATIPGAKPEEIKKKALEFVDYINAKLPGLLELEYEGFYVRGFFVTKKKYALIDEEGK
IITRGLEIVRRDWSEIAKETQAKVLEAILKHGNVEEAVKIVKEVTEKLSKYEIPPEKLVI
YEQITRPLHEYKAIGPHVAVAKRLAARGVKVRPGMVIGYIVLRGDGPISKRAILAEEFDL
RKHKYDAEYYIENQVLPAVLRILEAFGYRKEDLRWQKTKQTGLTAWLNIKKK

FIG. 133

Pfu polymerase UniProtKB - P61875 (DPOL_PYRFU) (SEQ ID NO:2508)

MILDVDYITEEGKPVIRLFKKENGKFKIEHDRTFRPYIYALLRDDSKIEEVKKITGERHG
KIVRIVDVEKVEKKFLGKPITVWKLYLEHPQDVPTIREKVREHPAVVDIFEYDIPFAKRY
LIDKGLIPMEGEEELKILAFDIETLYHEGEEFGKGPIIMISYADENEAKVITWKNIDLPY
VEVVSSEREMIKRFLRIIREKDPDIIVTYNGDSFDFPYLAKRAEKLGIKLTIGRDGSEPK
MQRIGDMTAVEVKGRIHFDLYHVITRTINLPTYTLEAVYEAIFGKPKEKVYADEIAKAWE
SGENLERVAKYSMEDAKATYELGKEFLPMEIQLSRLVGQPLWDVSRSSTGNLVEWFLLRK
AYERNEVAPNKPSEEEYQRRLRESYTGGFVKEPEKGLWENIVYLDFRALYPSIIITHNVS
PDTLNLEGCKNYDIAPQVGHKFCKDIPGFIPSLLGHLLEERQKIKTKMKETQDPIEKILL
DYRQKAIKLLANSFYGYYGYAKARWYCKECAESVTAWGRKYIELVWKELEEKFGFKVLYI
DTDGLYATIPGGESEEIKKKALEFVKYINSKLPGLLELEYEGFYKRGFFVTKKRYAVIDE
EGKVITRGLEIVRRDWSEIAKETQARVLETILKHGDVEEAVRIVKEVIQKLANYEIPPEK
LAIYEQITRPLHEYKAIGPHVAVAKKLAAKGVKIKPGMVIGYIVLRGDGPISNRAILAEE
YDPKKHKYDAEYYIENQVLPAVLRILEGFGYRKEDLRYQKTRQVGLTSWLNIKKS

FIG. 134

Pyrococcus abyssi polymerase UniProtKB - P0CL77 (DPOL_PYRAB) (SEQ ID NO:2509)

MIIDADYITEDGKPIIRIFKKEKGEFKVEYDRTFRPYIYALLKDDSAIDEVKKITAERHG
KIVRITEVEKVQKKFLGRPIEVWKLYLEHPQDVPAIREKIREHPAVVDIFEYDIPFAKRY
LIDKGLTPMEGNEELTFLAVDIETLYHEGEEFGKGPIIMISYADEEGAKVITWKSIDLPY
VEVVSSEREMIKRLVKVIREKDPDVIITYNGDNFDFPYLLKRAEKLGIKLPLGRDNSEPK
MQRMGDSLAVEIKGRIHFDLFPVIRRTINLPTYTLEAVYEAIFGKSKEKVYAHEIAEAWE
TGKGLERVAKYSMEDAKVTFELGKEFFPMEAQLARLVGQPVWDVSRSSTGNLVEWFLLRK
AYERNELAPNKPDEREYERRLRESYEGGYVKEPEKGLWEGIVSLDFRSLYPSIIITHNVS
PDTLNRENCKEYDVAPQVGHRFCKDFPGFIPSLLGNLLEERQKIKKRMKESKDPVEKKLL
DYRQRAIKILANSYYGYYGYAKARWYCKECAESVTAWGRQYIDLVRRELESRGFKVLYID
TDGLYATIPGAKHEEIKEKALKFVEYINSKLPGLLELEYEGFYARGFFVTKKKYALIDEE
GKIVTRGLEIVRRDWSEIAKETQAKVLEAILKHGNVDEAVKIVKEVTEKLSKYEIPPEKL
VIYEQITRPLSEYKAIGPHVAVAKRLAAKGVKVKPGMVIGYIVLRGDGPISKRAIAIEEF
DPKKHKYDAEYYIENQVLPAVERILRAFGYRKEDLKYQKTKQVGLGAWLKF

FIG. 135

RB69 polymerase UniProtKB - Q38087 (DPOL_BPR69) (SEQ ID NO:2510)

MKEFYLTVEQIGDSIFERYIDSNGRERTREVEYKPSLFAHCPESQATKYFDIYGKPCTRK
LFANMRDASQWIKRMEDIGLEALGMDDFKLAYLSDTYNYEIKYDHTKIRVANFDIEVTSP
DGFPEPSQAKHPIDAITHYDSIDDRFYVFDLLNSPYGNVEEWSIEIAAKLQEQGGDEVPS
EIIDKIIYMPFDNEKELLMEYLNFWQQKTPVILTGWNVESFDIPYVYNRIKNIFGESTAK
RLSPHRKTRVKVIENMYGSREIITLFGISVLDYIDLYKKFSFTNQPSYSLDYISEFELNV
GKLKYDGPISKLRESNHQRYISYNIIDVYRVLQIDAKRQFINLSLDMGYYAKIQIQSVFS
PIKTWDAIIFNSLKEQNKVIPQGRSHPVQPYPGAFVKEPIPNRYKYVMSFDLTSLYPSII
RQVNISPETIAGTFKVAPLHDYINAVAERPSDVYSCSPNGMMYYKDRDGVVPTEITKVFN
QRKEHKGYMLAAQRNGEIIKEALHNPNLSVDEPLDVDYRFDFSDEIKEKIKKLSAKSLNE
MLFRAQRTEVAGMTAQINRKLLINSLYGALGNVWFRYYDLRNATAITTFGQMALQWIERK
VNEYLNEVCGTEGEAFVLYGDTDSIYVSADKIIDKVGESKFRDTNHWVDFLDKFARERME
PAIDRGFREMCEYMNNKQHLMFMDREAIAGPPLGSKGIGGFWTGKKRYALNVWDMEGTRY
AEPKLKIMGLETQKSSTPKAVQKALKECIRRMLQEGEESLQEYFKEFEKEFRQLNYISIA
SVSSANNIAKYDVGGFPGPKCPFHIRGILTYNRAIKGNIDAPQVVEGEKVYVLPLREGNP
FGDKCIAWPSGTEITDLIKDDVLHWMDYTVLLEKTFIKPLEGFTSAAKLDYEKKASLFDM
FDF

FIG. 136

Phi29 DNA polymerase UniProtKB/Swiss-Prot: P03680.1 (SEQ ID NO:2455)

MKHMPRKMYSCDFETTTKVEDCRVWAYGYMNIEDHSEYKIGNSLDEFMAWVLKVQADLYF
HNLKFDGAFIINWLERNGFKWSADGLPNTYNTIISRMGQWYMIDICLGYKGKRKIHTVIY
DSLKKLPFPVKKIAKDFKLTVLKGDIDYHKERPVGYKITPEEYAYIKNDIQIIAEALLIQ
FKQGLDRMTAGSDSLKGFKDIITTKKFKKVFPTLSLGLDKEVRYAYRGGFTWLNDRFKEK
EIGEGMVFDVNSLYPAQMYSRLLPYGEPIVFEGKYVWDEDYPLHIQHIRCEFELKEGYIP
TIQIKRSRFYKGNEYLKSSGGEIADLWLSNVDLELMKEHYDLYNVEYISGLKFKATTGLF
KDFIDKWTYIKTTSEGAIKQLAKLMLNSLYGKFASNPDVTGKVPYLKENGALGFRLGEEE
TKDPVYTPMGVFITAWARYTTITAAQACYDRIIYCDTDSIHLTGTEIPDVIKDIVDPKKL
GYWAHESTFKRAKYLRQKTYIQDIYMKEVDGKLVEGSPDDYTDIKFSVKCAGMTDKIKKE
VTFENFKVGFSRKMKPKPVQVPGGVVLVDDTFTIK

FIG. 137

Table 1: Wild type RLF 89458.1 = SEQ ID NO:1; wild type RLF 78286 = SEQ ID NO:2

| SEQ#: | Mutations based on SEQ ID NOS: 1 or 2 | Incorp'n |
|---|---|---|
| 3 | Y7F_D141A_E143A_Y261A_L409S_Y410A_A485S_C509V | ++ |
| 4 | D141A_E143A_Y261A_L409Y_Y410A_T514S | ++ |
| 5 | Y7F_D141A_E143A_Y261A_L409S_Y410A_P411G_A485S | + |
| 6 | I48V_K52R_G77D_V86A_D141A_E143A_Y261A_L409S_Y410A_P411G | ++ |
| 7 | D141A_E143A_Y261A_L409S_Y410A_P411G_G676S | 0 |
| 8 | I65V_I66V_I96K_E111G_E130V_D141A_E143A_Y261A_L409S_Y410A_P411G | + |
| 9 | D141A_E143A_Y261A_L409Y_Y410A_P411I | 0 |
| 10 | I51K_K61M_P79S_D141A_E143A_Y261A_L409S_Y410A_P411G | + |
| 11 | P115R_D141A_E143A_Y261A_L409S_Y410A_P411G | 0 |
| 12 | G56D_K70I_R119C_L135P_D141A_E143A_Y261A_L409S_Y410A_P411G | + |
| 13 | D141A_E143A_Y261A_L409F_Y410G | + |
| 14 | D141A_E143A_Y261A_L409S_Y410A_P411G_K561N_G572S_M573I_G585D | + |
| 15 | D141A_E143A_Y261A_L409S_Y410A_P411G_A650T_D720Y | 0 |
| 16 | E29V_R67C_P94S_D113G_D141A_I142F_E143A_Y261A_L409S_Y410A_P411G | + |
| 17 | D141A_E143A_Y261A_L409S_Y410A_P411G_I714F_Y756F | 0 |
| 18 | D141A_E143A_Y261A_L409S_Y410A_P411G_Y652H_V654M_D671G_D717N_D753E | ++ |
| 19 | E35K_K73E_D92V_R101H_D141A_E143A_Y261A_L409S_Y410A_P411G | + |

FIG. 138-1

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 20 | F34I_Q91R_R97H_D141A_E143A_Y261A_L409S_Y410A_P411G | + |
| 21 | D141A_E143A_Y261A_L409F_Y410A | ++ |
| 22 | D141A_E143A_Y261A_L409F_Y410A_P411G | 0 |
| 23 | V93M_G131S_D141A_E143A_Y261A_L409S_Y410A_P411G | + |
| 24 | D141A_E143A_Y261A_L409Y_Y410A_T514A | ++ |
| 25 | P94F_D141A_E143A_Y261A_L409S_Y410A_P411G | 0 |
| 26 | D141A_E143A_Y261A_L409S_Y410A_P411G_K637M_V646A_D720V_F747L_D753V | ++ |
| 27 | Y7A_D141A_E143A_Y261A_L409S_Y410A | ++ |
| 28 | Y7F_D141A_E143A_Y261A_L409S_Y410A_P411G_A485S_K507L | + |
| 29 | I65N_F87C_P94S_A99T_M129L_D141A_E143A_Y261A_L409S_Y410A_P411G | + |
| 30 | E22G_I54T_V63A_D92N_K124N_D141A_E143A_Y261A_L409S_Y410A_P411G | 0 |
| 31 | R58C_V68M_P90L_A99T_K136R_D141A_E143A_Y261A_L409S_Y410A_P411G | + |
| 32 | D141A_E143A_Y261A_L409Y_Y410G | ++ |
| 33 | D141A_E143A_Y261A_L409Y_Y410A_P411V | 0 |
| 34 | D141A_E143A_K240S_Y261A_L409S_Y410A_P411G | 0 |
| 35 | E78G_I109N_E111V_D123N_E130V_D141A_E143A_Y261A_L409S_Y410A_P411G | + |
| 36 | D141A_E143A_Y261A_S347N_G373S_L404Q_L409S_Y410A_P411G_L424Q_F448I_V463M | + |
| 37 | D141A_E143A_Y261A_L409A_Y410G_T514G | ++ |
| 38 | D141A_E143A_Y261A_L409S_Y410G_P411I | 0 |

FIG. 138-2

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 39 | H89D_I96T_L137F_D141A_E143A_Y261A_L409S_Y410A_P411G | ++ |
| 40 | K52I_D141A_E143A_Y261A_L409S_Y410A_P411G | + |
| 41 | D141A_E143A_Y261A_L409S_Y410A_P411G_I521N | 0 |
| 42 | D141A_E143A_Y261A_L409S_Y410A_P411G_G585A | 0 |
| 43 | D141A_E143A_Y261A_L409S_Y410A_P411G_H678K | 0 |
| 44 | D141A_E143A_Y261A_L409A_Y410G_P411G_T514A | ++ |
| 45 | D141A_E143A_Y261A_Q378R_F406Y_L409S_Y410A_P411G_T423I_A485T_Q497H | + |
| 46 | Y7F_A117V_D141A_E143A_Y261A_L409S_Y410A_V415R_A434D_A485S_K507L_I521H | ++ |
| 47 | G12E_D141A_E143A_Y261A_L409S_Y410A_P411G | 0 |
| 48 | D141A_E143A_Y261A_L409S_Y410A_P411G_H678R | 0 |
| 49 | E78N_D141A_E143A_Y261A_L409S_Y410A_V415K_A434D_A485S_S492G_K507L_I521T_D671R | ++ |
| 50 | Y7F_E78S_D141A_E143A_Y261A_L409S_Y410A_P411G_V415R_A485S | + |
| 51 | E10D_G12S_E22V_G24S_D123E_D141A_E143A_Y261A_L409S_Y410A_P411G | + |
| 52 | D141A_E143A_C223V_Y261A_L409S_Y410A_P411G_A485S_K507L_D671R | + |
| 53 | D141A_E143A_Y261A_L409S_Y410A_P411G_I709F_K725E | 0 |
| 54 | D141A_E143A_Y261A_L409A_Y410G | ++ |
| 55 | D141A_E143A_Y261A_L409S_Y410A_P411G_C509S_S557C_I596T | + |
| 56 | D6S_D141A_E143A_Y261A_L409S_Y410A_P411G | 0 |
| 57 | D141A_E143A_Y261A_V360A_E394G_L409S_Y410A_P411G_P421S_K443R_Q497H | + |

FIG. 138-3

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 58 | D141A_E143A_Y261A_L357P_R359H_L409S_Y410A_P411G | ++ |
| 59 | D141A_E143A_Y261A_L409Y_Y410G_T514G | ++ |
| 60 | D141A_E143A_Y261A_L409S_Y410A_P411G_K693M_K708M | ++ |
| 61 | D141A_E143A_Y261A_L409F_Y410A_P411A | 0 |
| 62 | D141A_E143A_Y261A_L367P_L409S_Y410A_P411G | + |
| 63 | D141A_E143A_Y261A_L409S_Y410G_P411G | 0 |
| 64 | G12S_R32C_L42Q_D44N_E57G_I66N_R97C_D98V_D141A_E143A_Y261A_L409S_Y410A_P411G | + |
| 65 | I51F_K53E_T55I_E57K_L76Q_A95V_R97C_L126F_A139E_D141A_E143A_Y261A_L409S_Y410A_P411G | + |
| 66 | Y7F_D141A_E143A_Y261A_Y362I_L409F_Y410A_P411G | ++ |
| 67 | Y7F_D141A_E143A_Y261A_Y362I_L409A_Y410A_P411A | 0 |
| 68 | V15M_I28T_E43K_K62R_R97C_D141A_E143A_Y261A_L409S_Y410A_P411G | + |
| 69 | D141A_E143A_Y261A_L409S_Y410A_P411G_C509V | ++ |
| 70 | D141A_E143A_Y261A_L409A_Y410G_P411A_T514S | ++ |
| 71 | D141A_E143A_Y261A_L409A_Y410G_P411G_T514S | ++ |
| 72 | E81D_P90R_D123V_K124E_D141A_E143A_Y261A_L409S_Y410A_P411G | + |
| 73 | D141A_E143A_Y261A_V353Q_Y403H_L409S_Y410A_P411G_I413F | + |

FIG. 138-4

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 74 | Y7F_E78S_A117V_D141A_E143A_Y261A_Y362I_L409S_Y410A_A434D_A485S_S492G_K507L_T523I | + |
| 75 | D141A_E143A_Y261A_L409F_Y410G_P411V | 0 |
| 76 | Y7F_D141A_E143A_Y261A_L409S_Y410A_P411G_A485S_C509V_I521T | ++ |
| 77 | D141A_E143A_Y261A_L409S_Y410A_P411G_G495S | 0 |
| 78 | D141A_E143A_Y261A_Y356C_L409S_Y410A_P411G | + |
| 79 | D141A_E143A_Y261A_L409Y_Y410A | ++ |
| 80 | Y7F_D141A_E143A_Y261A_L409F_Y410A_P411A | 0 |
| 81 | D98N_R107S_R119H_D141A_E143A_Y261A_L409S_Y410A_P411G | + |
| 82 | D141A_E143A_Y261A_L409A_Y410G_P411V | 0 |
| 83 | D141A_E143A_Y261A_L409A_Y410G_P411A | + |
| 84 | D141A_E143A_Y261A_L409S_Y410A_P411G_S506C_R518C_P552L | + |
| 85 | D141A_E143A_Y261A_L409A_Y410A | ++ |
| 86 | D141A_E143A_C223V_Y261A_L409S_Y410A_P411G | + |
| 87 | A117V_D141A_E143A_Y261A_L409S_Y410A_A485S_S492G_K507L_D671R | ++ |
| 88 | K27M_D92N_F140S_D141A_E143A_Y261A_L409S_Y410A_P411G | + |
| 89 | D141A_E143A_Y261A_L409Y_Y410A_P411A | + |
| 90 | D141A_E143A_Y261A_L409S_Y410A_P411G_A623T_V628L_A650E_A674T_K707I_F747L_Y749F | + |
| 91 | D141A_E143A_Y261A_L409S_Y410A_P411G_G633S_V645E | 0 |

FIG. 138-5

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 92 | K21E_E29V_E43D_D141A_E143A_Y261A _L409S_Y410A_P411G | + |
| 93 | D141A_E143A_Y261A_L409S_Y410A_P411G _A638E_K658R_A680V | + |
| 94 | A117V_D141A_E143A_Y261A_L409S_Y410A _P411G_A434D_A485S | + |
| 95 | D141A_E143A_Y261A_P372S_L409S_Y410A _P411G_V415M_G447D_D455N | + |
| 96 | D141A_E143A_Y261A_G388S_L409S_Y410A_P411G | 0 |
| 97 | E35G_I66T_V86D_D98E_D141A_E143A _Y261A_L409S_Y410A_P411G | ++ |
| 98 | V93A_E130G_D141A_E143A_Y261A_L409S _Y410A_P411G | + |
| 99 | Y7F_A117V_D141A_E143A_Y261A_L409S _Y410A_V415K_A485S_Y494A_K507L_I521H | ++ |
| 100 | D141A_E143A_Y261A_L409A_Y410G_P411G | + |
| 101 | D141A_E143A_Y261A_L409A_Y410G_T514A | ++ |
| 102 | D141A_E143A_Y261A_L409F_Y410G_P411A | 0 |
| 103 | E46V_D141A_E143A_Y261A_L409S_Y410A_P411G | ++ |
| 104 | Y7F_D141A_E143A_Y261A_L409S_Y410A _P411A | 0 |
| 105 | D141A_E143A_Y261A_G388R_L409S_Y410A _P411G | 0 |
| 106 | D141A_E143A_Y261A_S345C_Y356N_L409S _Y410A_P411G | + |
| 107 | I28N_R97S_E108V_D141A_E143A_Y261A _L409S_Y410A_P411G | + |
| 108 | D141A_E143A_Y261A_L409S_Y410A_P411G _K670E_L685E_L715Q_E718V_R723H_Q761L | 0 |
| 109 | D141A_E143A_Y261A_Y362I_L409S_Y410A_P411G | 0 |
| 110 | L42P_I65F_V71I_K72V_R97C_I100T _P104T_K136E_D141A_E143A_Y261A _L409S_Y410A_P411G | ++ |

FIG. 138-6

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 111 | D141A_E143A_Y261A_L409Y_Y410A_P411G | ++ |
| 112 | D141A_E143A_Y261A_L409S_Y410A_P411G_L649Q_I698K | ++ |
| 113 | D141A_E143A_Y261A_L409S_Y410A_P411G_A485S_K507L | + |
| 114 | H59L_V63D_V68M_H89A_Y112C_I122N_D141A_E143A_Y261A_L409S_Y410A_P411G | + |
| 115 | R58H_E69K_Q91L_S102G_D141A_E143A_Y261A_L409S_Y410A_P411G | ++ |
| 116 | I54T_D113G_D141A_E143A_Y261A_L409S_Y410A_P411G | + |
| 117 | D141A_E143A_Y261A_L409S_Y410A_P411G_R631C_A650V_Y652H_K658E_E718K | 0 |
| 118 | D141A_E143A_Y261A_G350S_L409S_Y410A_P411G | 0 |
| 119 | K23M_D31V_F34I_G60D_V68M_V86I_R97H_R107C_F110S_D141A_E143A_Y261A_L409S_Y410A_P411G | + |
| 120 | D141A_E143A_Y261A_L409S_Y410A_P411G_T621I_I665V | + |
| 121 | D141A_E143A_Y261A_L409S_Y410A_P411V | 0 |
| 122 | A117V_D141A_E143A_Y261A_L409S_Y410A_P411G_I521H | + |
| 123 | P115S_D141A_E143A_Y261A_L409S_Y410A_P411G | 0 |
| 124 | R17H_G60D_D123E_D141A_E143A_Y261A_L409S_Y410A_P411G | + |
| 125 | D141A_E143A_Y261A_Y362I_L409A_Y410A_P411A | 0 |
| 126 | D141A_E143A_Y261A_L409A_Y410A_P411I | 0 |
| 127 | D141A_E143A_Y261A_N365S_L409S_Y410A_P411G_V419I_I436F_L453Q | 0 |
| 128 | D141A_E143A_Y261A_L409S_Y410A_P411G_A674S | 0 |
| 129 | D141A_E143A_Y261A_Y410G_P411I | 0 |

FIG. 138-7

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 130 | D141A_E143A_Y261A_L409S_Y410A_P411G_G606S | 0 |
| 131 | H59Y_E111G_M129K_D141A_E143A_Y261A_L409S_Y410A_P411G | + |
| 132 | D141A_E143A_Y261A_L409A_Y410G_P411I | 0 |
| 133 | Y7F_D141A_E143A_Y261A_Y362I_L409S_Y410A_P411G | 0 |
| 134 | I54N_A117T_D141A_E143A_Y261A_L409S_Y410A_P411G | ++ |
| 135 | D141A_E143A_C223V_Y261A_L409S_Y410A_V415K_A485S | ++ |
| 136 | D141A_E143A_Y261A_L409S_Y410A_P411G_R631H_S706C_Q757L | + |
| 137 | D141A_E143A_Y261A_L409S_Y410A_P411G_E663R | 0 |
| 138 | D141A_E143A_Y180F_Y261A_V308I_L409S_Y410A_P411G | + |
| 139 | Y7F_E78S_D141A_E143A_Y261A_L409S_Y410A_P411G_V415K_A485S | + |
| 140 | D141A_E143A_Y261A_Y362I_L409F_Y410A_P411G | 0 |
| 141 | F19S_F34S_T55I_I114T_D141A_E143A_Y261A_L409S_Y410A_P411G | ++ |
| 142 | D141A_E143A_E238R_Y261A_L409S_Y410A_P411G | 0 |
| 143 | D141A_E143A_E251S_Y261A_L409S_Y410A_P411G | 0 |
| 144 | D141A_E143A_Y261A_L409A_Y410G_P411A_T514A | ++ |
| 145 | Y7F_D141A_E143A_Y261A_L409A_Y410A_P411A | 0 |
| 146 | P90L_D141A_E143A_Y261A_L409S_Y410A_P411G | + |

FIG. 138-8

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 147 | D141A_E143A_Y261A_L409S_Y410A_P411G_R631H_Q686R_K691R_S721N_Q757L | 0 |
| 148 | D141A_E143A_Y261A_L409Y_Y410G_P411A | 0 |
| 149 | G12D_F19I_E57K_G60S_R101C_D123G_D141A_E143A_Y261A_L409S_Y410A_P411G | + |
| 150 | D141A_E143A_Y261A_L409F_Y410G_P411G | 0 |
| 151 | I16N_F34S_K118M_K136R_D141A_E143A_Y261A_L409S_Y410A_P411G | + |
| 152 | D141A_E143A_E238S_Y261A_L409S_Y410A_P411G | 0 |
| 153 | I28N_R58C_P90L_D141A_E143A_Y261A_L409S_Y410A_P411G | + |
| 154 | D141A_E143A_Y261A_S348C_L409S_Y410A_P411G_D422V | + |
| 155 | P36L_E111V_K136E_D141A_E143A_Y261A_L409S_Y410A_P411G | + |
| 156 | Y7F_E78S_A117V_D141A_E143A_Y261A_Y362I_L409S_Y410A_A434D_A485S_S492G_K507L_I521H | ++ |
| 157 | D141A_E143A_Y261A_L409A_Y410G_T514S | ++ |
| 158 | P94S_R119C_L126P_E130T_D141A_E143A_Y261A_L409S_Y410A_P411G | + |
| 159 | Y7F_E78S_D141A_E143A_Y261A_Y362I_L409S_Y410A_A434D_A485S_Y494A_K507L_D671R | ++ |
| 160 | V68M_D141A_E143A_Y261A_L409S_Y410A_P411G | + |
| 161 | D141A_E143A_Y261A_L409Y_Y410G_T514S | ++ |
| 162 | G12S_E49G_V93M_D141A_E143A_Y261A_L409S_Y410A_P411G | + |
| 163 | P36L_R97C_I109N_D141A_E143A_Y261A_L409S_Y410A_P411G | + |
| 164 | D141A_E143A_Y261A_L409A_Y410A_P411V | 0 |

FIG. 138-9

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 165 | P90L_A95V_P115L_E130D_D141A_E143A_Y261A_L409S_Y410A_P411G | + |
| 166 | F19Y_Y39F_K74E_V106A_K136E_D141A_E143A_Y261A_L409S_Y410A_P411G | + |
| 167 | E78S_D141A_E143A_Y261A_L409S_Y410A_V415K_A485S_K507L | + |
| 168 | D141A_E143A_Y261A_L409S_Y410A_P411I | 0 |
| 169 | D141A_E143A_Y261A_L409S_Y410A_V415K_A485S | + |
| 170 | E43K_K74R_L135Q_L138P_D141A_E143A_Y261A_L409S_Y410A_P411G | 0 |
| 171 | Y7F_E78S_A117V_D141A_E143A_Y261A_Y362I_L409S_Y410A_V415K_A485S_Y494N_K507L_I521T_E663K_D671R | + |
| 172 | I8S_D141A_E143A_Y261A_L409S_Y410A_P411G | 0 |
| 173 | D141A_E143A_Y261A_Y362I_L409F_Y410A_P411A | 0 |
| 174 | K74R_I80N_P90L_F116S_D141A_E143A_Y261A_L409S_Y410A_P411G | + |
| 175 | D141A_E143A_Y261A_V360D_L409S_Y410A_P411G | + |
| 176 | D141A_E143A_Y261A_W355R_G396S_L409S_Y410A_P411G_A434V_R440H_I474V | + |
| 177 | D141A_E143A_Y261A_L409S_Y410G_P411A | 0 |
| 178 | A117V_D141A_E143A_Y261A_L409S_Y410A_V415R_A485S | ++ |
| 179 | D141A_E143A_Y261A_L409A_Y410A_T514S | ++ |
| 180 | D141A_E143A_Y261A_L409F_Y410A_P411I | 0 |
| 181 | D141A_E143A_Y261A_Y389R_L409S_Y410A_P411G | 0 |
| 182 | D141A_E143A_Y261A_P328A_L352M_A402T_L409S_Y410A_P411G_E427G_C428Y_I436T | + |

FIG. 138-10

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 183 | D141A_E143A_Y261A_L409S_Y410A_P411G_I709V_D720E_G765S | 0 |
| 184 | K27M_D45V_R58C_D141A_E143A_Y261A_L409S_Y410A_P411G | 0 |
| 185 | D141A_E143A_Y261A_L409S_Y410A_P411G_K619R_V628L_I641F_V656I_I665V_S706N | ++ |
| 186 | A117V_D141A_E143A_Y261A_L409S_Y410A_P411G_A485S_S492G | + |
| 187 | P94L_H103R_P115L_D141A_E143A_Y261A_L409S_Y410A_P411G | + |
| 188 | D141A_E143A_Y261A_L409A_Y410A_P411G_T514G | ++ |
| 189 | Y7F_A117V_D141A_E143A_Y261A_L409S_Y410A_A434D_A485S_Y494A_K507L_S512R_I521H_E663K | + |
| 190 | D141A_E143A_Y261A_M381R_L409S_Y410A_P411G | 0 |
| 191 | D141A_E143A_Y261A_Y410A_P411G | 0 |
| 192 | E78N_A117V_D141A_E143A_Y261A_Y362I_L409S_Y410A_A485S_K507L_D671R | + |
| 193 | D141A_E143A_Y261A_L409S_Y410A_P411G | ++ |
| 194 | E43V_R97C_P128L_D141A_E143A_Y261A_L409S_Y410A_P411G | ++ |
| 195 | D141A_E143A_Y261A_L409S_Y410A_P411G_C509Y_H565Y_K569E_I617V | + |
| 196 | Y7F_D141A_E143A_Y261A_Y362I_L409S_Y410A_P411A | 0 |
| 197 | D141A_E143A_Y261A_L409Y_Y410G_P411I | 0 |
| 198 | D141A_E143A_E251R_Y261A_L409S_Y410A_P411G | 0 |
| 199 | E78N_D141A_E143A_C223V_Y261A_L409S_Y410A_V415K_A485S | + |
| 200 | Y7F_D141A_E143A_Y261A_L409F_Y410A_P411G | 0 |

FIG. 138-11

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 201 | D141A_E143A_Y261A_L409S_Y410A_P411G_E620K_V740I | 0 |
| 202 | Y7F_A117V_D141A_E143A_Y261A_Y362I_L409S_Y410A_A485S_Y494A_K507L_S512R_I521T_E663K | + |
| 203 | D141A_E143A_Y261A_L409S_Y410A_P411G_E627K_H662V_E668G | 0 |
| 204 | Y7F_D141A_E143A_Y261A_L409S_Y410A_P411G | 0 |
| 205 | Y7F_E78N_A117V_D141A_E143A_Y261A_Y362I_L409S_Y410A_A434D_A485S_Y494A_K507L_S512R_K592Q_E663K_D671R | + |
| 206 | F19Y_R119H_D141A_E143A_Y261A_L409S_Y410A_P411G | + |
| 207 | D141A_E143A_Y261A_L409A_Y410A_P411G | ++ |
| 208 | D141A_E143A_Y261A_L409A_Y410G_P411A_T514G | ++ |
| 209 | D141A_E143A_Y261A_Y385S_L409S_Y410A_P411G | 0 |
| 210 | E10V_D141A_E143A_Y261A_L409S_Y410A_P411G | + |
| 211 | K13E_H89Y_F116L_L121M_D141A_E143A_Y261A_L409S_Y410A_P411G | + |
| 212 | D141A_E143A_Y261A_L409S_Y410A_P411G_P677L_R684H | 0 |
| 213 | I80F_R101C_P115S_E130D_D141A_I142V_E143A_Y261A_L409S_Y410A_P411G | ++ |
| 214 | P36L_D50V_L85V_F87L_R97P_D141A_E143A_Y261A_L409S_Y410A_P411G | + |
| 215 | R67C_I80N_V93A_D141A_E143A_Y261A_L409S_Y410A_P411G | + |
| 216 | E35D_R58C_E78K_I80N_P90S_E130K_D141A_E143A_Y261A_L409S_Y410A_P411G | + |
| 217 | D141A_E143A_Y261A_L404Q_L409S_Y410A_P411G_F448I_I449N_K468R_D472V | + |

FIG. 138-12

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 218 | A117V_D141A_E143A_Y261A_L409S_Y410A_V415R_A485S_C509V | ++ |
| 219 | F87I_D141A_E143A_Y261A_L409S_Y410A_P411G | ++ |
| 220 | D141A_E143A_Y261A_L409A_Y410G_P411G_T514G | + |
| 221 | D141A_E143A_Y261A_L409S_Y410A_P411G_G676S_A746V_R758H | + |
| 222 | Y7F_E78N_A117V_D141A_E143A_Y261A_Y362I_L409S_Y410A_A434D_A485S_S492G_K507L_I521H_E663K_D671R | + |
| 223 | D141A_E143A_Y261A_L409A_Y410A_T514A | ++ |
| 224 | Y7F_D141A_E143A_Y261A_Y362I_L409F_Y410A_P411A | 0 |
| 225 | D141A_E143A_Y261A_L409F_Y410A_T514A | ++ |
| 226 | D141A_E143A_Y261A_L409S_Y410A_P411G_I629F_A639T_Q735H_A746V_K750N | ++ |
| 227 | D141A_E143A_Y261A_L409S_Y410A_V415K_A485S_D671R | ++ |
| 228 | K62E_V93A_M129V_D141A_E143A_P239S_Y261A_L409S_Y410A_P411G | + |
| 229 | D141A_E143A_Y261A_L409S_Y410A_P411G_E647G | ++ |
| 230 | G24S_R58L_F110L_R119H_M129I_D141A_E143A_Y261A_L409S_Y410A_P411G | + |
| 231 | D141A_E143A_Y261A_L409F_Y410A_T514S | ++ |
| 232 | Y7F_E78N_A117V_D141A_E143A_Y261A_Y362I_L409S_Y410A_A485S_Y494A_K507L_I521H | ++ |
| 233 | Y7F_D141A_E143A_Y261A_Y362I_L409S_Y410A_P411G_A485S_S492G_C509V | + |
| 234 | D141A_E143A_Y261A_L409S_Y410A_P411G_V610D_L715P | + |
| 235 | T55S_G56S_R58C_R97H_D141A_E143A_Y261A_L409S_Y410A_P411G | + |

FIG. 138-13

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 236 | E78S_M129L_D141A_E143A_Y261A_L409S_Y410A_V415K_A485S | ++ |
| 237 | A117V_D141A_E143A_Y261A_L409S_Y410A_A434D_A485S_I521H_D671R | ++ |
| 238 | Y37N_S47G_R97H_K118R_D141A_E143A_Y261A_L409S_Y410A_P411G | + |
| 239 | D141A_E143A_Y261A_L409S_Y410A_P411G_H519N_I521N_I547F_V588E | + |
| 240 | Y7F_E78S_A117V_D141A_E143A_Y261A_Y362I_L409S_Y410A_V415K_A434D_A485S_Y494A_K507L_I521T_E663K_D671R | + |
| 241 | A117V_D141A_E143A_Y261A_Y362I_L409S_Y410A_V415R_A485S | + |
| 242 | D141A_E143A_Y261A_L409S_Y410A_P411G_T621S_E668G_L703P_E718K_Q757L | ++ |
| 243 | D141A_E143A_Y261A_L409Y_Y410G_T514A | ++ |
| 244 | Q91A_D141A_E143A_Y261A_L409S_Y410A_P411G | 0 |
| 245 | D141A_E143A_Y261A_L409S_Y410A_P411G_E508Q_E511K_I547T_H601R | + |
| 246 | D141A_E143A_Y261A_L409S_Y410A_P411G_K673I_S721C_V736A | 0 |
| 247 | I16T_G60S_I65T_A99T_S102N_D141A_E143A_Y261A_L409S_Y410A_P411G | + |
| 248 | K72R_A95V_R107C_E111V_P115S_D141A_E143A_Y261A_L409S_Y410A_P411G | + |
| 249 | D141A_E143A_Y261A_L409F_Y410A_T514G | ++ |
| 250 | D141A_E143A_Y261A_L409S_Y410A_K507L | + |
| 251 | P90D_D141A_E143A_Y261A_L409S_Y410A_P411G | + |
| 252 | D141A_E143A_Y261A_Y385R_L409S_Y410A_P411G | 0 |
| 253 | I38N_A95V_I122F_D141A_E143A_Y261A_L409S_Y410A_P411G | + |
| 254 | P94Q_D141A_E143A_Y261A_L409S_Y410A_P411G | 0 |

FIG. 138-14

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 255 | V71I_I122F_D141A_E143A_Y261A_L409S_Y410A_P411G | + |
| 256 | Y7F_E78S_A117V_D141A_E143A_Y261A_Y362I_L409S_Y410A_V415R_A485S_I521T_D671R | + |
| 257 | D141A_E143A_Y261A_L409Y_Y410A_T514G | ++ |
| 258 | Y7F_E78S_D141A_E143A_C223V_Y261A_L409S_Y410A_V415K_A485S_D671R | ++ |
| 259 | D141A_E143A_Y261A_L409Y_Y410G_P411G | 0 |
| 260 | Y7F_E78S_A117V_D141A_E143A_Y261A_Y362I_L409S_Y410A_A434D_A485S_I521T_E663K_D671R | + |
| 261 | A40V_R119S_K136R_D141A_E143A_Y261A_L409S_Y410A_P411G | + |
| 262 | F75C_D92V_P94L_Y120C_D141A_E143A_Y261A_L409S_Y410A_P411G | ++ |
| 263 | Y7F_D141A_E143A_Y261A_L409S_Y410A_V415K_A485S_D671R | 0 |
| 264 | D141A_E143A_Y261A_L409F_Y410A_P411V | 0 |
| 265 | D141A_E143A_Y261A_G338D_E376K_L409S_Y410A_P411G_I449F_S451N | + |
| 266 | D141A_E143A_Y261A_L409S_Y410A_P411G_E636G_D711G_F716L_D720V_P728L_Y730H_K752E_T762N | 0 |
| 267 | I28F_I122F_L135M_D141A_E143A_Y261A_L409S_Y410A_P411G | ++ |
| 268 | D141A_E143A_Y261A_L409S_Y410A_P411G_S634C_V645I_R653C_V736A | 0 |
| 269 | I16F_K23E_L41P_E49K_D141A_E143A_Y261A_L409S_Y410A_P411G | + |
| 270 | D44N_S47R_F87I_Y120N_D141A_E143A_Y261A_L409S_Y410A_P411G | + |
| 271 | D141A_E143A_Y261A_L409S_Y410A_P411G_E663S | 0 |

FIG. 138-15

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 272 | D4N_A95V_R119H_F140Y_D141A_E143A_Y261A_L409S_Y410A_P411G | + |
| 273 | E46V_S47N_E57G_Q91H_I109K_D141A_E143A_Y261A_L409S_Y410A_P411G | + |
| 274 | I16T_V63I_D141A_E143A_Y261A_L409S_Y410A_P411G | 0 |
| 275 | D141A_E143A_Y261A_L409S_Y410A_P411G_S699I_Y756C | ++ |
| 276 | D141A_E143A_Y261A_L409A_Y410A_P411G_T514A | ++ |
| 277 | D141A_E143A_Y261A_Y389S_L409S_Y410A_P411G | 0 |
| 278 | D141A_E143A_Y261A_Y410A_P411A | 0 |
| 279 | P36L_E130G_D141A_E143A_Y261A_L409S_Y410A_P411G | ++ |
| 280 | D141A_E143A_Y261A_L409S_Y410A_P411G_D648V_E668K_A674V_V692I_V702A_Q735H | 0 |
| 281 | E57G_R97L_D113Y_E130K_D141A_E143A_Y261A_L409S_Y410A_P411G | + |
| 282 | R101C_D141A_E143A_Y261A_L409S_Y410A_P411G | + |
| 283 | D141A_E143A_Y261A_F406Y_L409S_Y410A_P411G_S412N_F448L_I474F | + |
| 284 | D141A_E143A_Y261A_L409A_Y410A_P411G_T514S | ++ |
| 285 | D141A_E143A_Y261A_L409S_Y410A_P411G_I629F_L630Q_V642I_K658I | 0 |
| 286 | D141A_E143A_Y261A_N351S_M381I_L409S_Y410A_P411G_P450L | ++ |
| 287 | F26L_I38T_V86I_R101C_D141A_E143A_Y261A_L409S_Y410A_P411G | ++ |
| 288 | D141A_E143A_Y261A_L409S_Y410A_P411A | + |

FIG. 138-16

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 289 | E29D_D50G_V71I_V93E_H103L_V106T_D141A_E143A_Y261A_L409S_Y410A_P411G | + |
| 290 | K20M_P36L_A40G_K62N_D141A_E143A_Y261A_L409S_Y410A_P411G | + |
| 291 | D6R_D141A_E143A_Y261A_L409S_Y410A_P411G | 0 |
| 292 | F34S_D45V_T55A_I122F_G132S_D141A_E143A_Y261A_L409S_Y410A_P411G | + |
| 293 | D141A_E143A_Y261A_L409S_Y410A_P411G_E508Q_E511K_I547T_H601R | + |

FIG. 138-17

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 294 | D141A_E143A_Y261A_T267W_I268W_L409S_Y410A_P411G | + |
| 295 | I114M_D141A_E143A_Y261A_L409S_Y410A_P411G | + |
| 296 | V93Y_D141A_E143A_Y261A_T267V_I268M_L409S_Y410A_P411G_D671R | ++ |
| 297 | D6S_Y7F_D141A_E143A_E251R_Y261A_Y362I_L409F_Y410A_P411A | + |
| 298 | D141A_E143A_Y261A_R269N_L409S_Y410A_P411G | + |
| 299 | D141A_E143A_D343E_Y261A_L409S_Y410A_P411G | ++ |
| 300 | V93Y_D141A_E143A_Y261A_I268V_L409S_Y410A_P411G_D671R | ++ |
| 301 | D141A_E143A_Y261A_L409S_Y410A_P411G_D648V_G689S | + |
| 302 | D141A_E143A_Y261A_L409S_Y410A_P411G_I635N_K708R_S722G | ++ |
| 303 | D141A_E143A_Y261A_L409S_Y410A_P411G_L741Q | ++ |
| 304 | D141A_E143A_Y261A_T274E_L409S_Y410A_P411G | ++ |
| 305 | V93Y_D141A_E143A_Y261A_I268M_L409S_Y410A_P411G_Y481F_D671R | + |
| 306 | D141A_E143A_Y261A_L409S_Y410A_P411G_A650T | ++ |
| 307 | D141A_E143A_Y261A_L409S_Y410A_P411G_E668K_D671R | ++ |
| 308 | D141A_E143A_Y261A_L409S_Y410A_P411G_E745V_K752E | ++ |
| 309 | Y7F_V93Y_D141A_E143A_Y261A_G350S_Y362I_L409F_Y410A_P411A_D671R_E755(del) | + |
| 310 | Y7F_D141A_E143A_E251R_Y261A_Y362I_L409F_Y410A_P411A_D671R | ++ |

FIG. 139-1

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 311 | V93Y_D141A_E143A_Y261A_T267W_I268V_L409S_Y410A_P411G_D671R | ++ |
| 312 | D141A_E143A_Y261A_A298G_L409S_Y410A_P411G | + |
| 313 | V93Y_D141A_E143A_Y261A_L409S_Y410A_P411G_D541E_D671R | + |
| 314 | D141A_E143A_Y261A_L409S_Y410A_P411G_I665F_K707I_I709V_S721G_Q757^ | + |
| 315 | V93Y_D141A_E143A_Y261A_T267A_I268Y_L409S_Y410A_P411G_D671R | + |
| 316 | D141A_E143A_Y261A_L409S_Y410A_P411G_E636K_V654M_S706G_Q735R | ++ |
| 317 | V93Y_D141A_E143A_Y261A_Y362I_L409F_Y410A_P411A_E663S | + |
| 318 | D141A_E143A_Y261A_D315A_L409S_Y410A_P411G | + |
| 319 | V93Y_D141A_E143A_Y261A_L409S_Y410A_P411G_D539E_D671R | + |
| 320 | V93Y_D141A_E143A_Y261A_I268W_L409S_Y410A_P411G_Y481A_D671R | + |
| 321 | V93Y_D141A_E143A_Y261A_L409S_Y410A_P411G_D539A_D671R | + |
| 322 | D141A_E143A_Y261A_L409S_Y410A_P411G_K707N | + |
| 323 | V93Y_D141A_E143A_Y261A_I268F_L409S_Y410A_P411G_Y481V_D671R | ++ |
| 324 | D141A_E143A_Y261A_L409S_Y410A_P411G_E620K_D671R | + |
| 325 | V93Y_D141A_E143A_Y261A_I268M_L409S_Y410A_P411G_D671R | ++ |
| 326 | V93Y_D141A_E143A_Y261A_T267V_I268W_L409S_Y410A_P411G_D671R | ++ |
| 327 | D141A_E143A_Y261A_L409S_Y410A_P411G_R758^ | + |

FIG. 139-2

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 328 | D141A_E143A_Y261A_L409S_Y410A_P411G_R612W | + |
| 329 | V93T_D141A_E143A_Y261A_L409S_Y410A_P411G_D671R | + |
| 330 | D141A_E143A_Y209W_Y261A_L409S_Y410A_P411G | + |
| 331 | Y7F_D141A_E143A_Y261A_A485L | ++ |
| 332 | D141A_E143A_G245S_Y261A_L409S_Y410A_P411G | + |
| 333 | V93Y_D141A_E143A_Y261A_I268W_L409S_Y410A_P411G_Y481V_D671R | ++ |
| 334 | D6S_Y7F_D141A_E143A_Y261A_L409S_Y410A_P411G | + |
| 335 | D4A_D141A_E143A_E251R_Y261A_D343A_L409S_Y410A_P411G | + |
| 336 | D141A_E143A_F214E_Y261A_L409S_Y410A_P411G | + |
| 337 | Y7F_V93F_D141A_E143A_E251R_Y261A_G350S_Y362I_L409F_Y410A_P411A_E663S_V679S | + |
| 338 | I114T_D141A_E143A_Y261A_L409S_Y410A_P411G | + |
| 339 | D141A_E143A_Y261A_T267M_I268V_L409S_Y410A_P411G | + |
| 340 | D141A_E143A_Y261A_T267W_I268Y_L409S_Y410A_P411G | + |
| 341 | D141A_E143A_Y261A_L409S_Y410A_P411G_Q686L | + |
| 342 | D141A_E143A_Y261A_N351S_L409S_Y410A_P411G | ++ |
| 343 | D141A_E143A_R247H_Y261A_P271S_L409S_Y410A_P411G | + |
| 344 | D141A_E143A_Y261A_T267F_I268Y_L409S_Y410A_P411G | + |

FIG. 139-3

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 345 | D141A_E143A_Y261A_L409S_Y410A_P411G_R631H_R653Y_S722G_I732T_Q735H | + |
| 346 | D141A_E143A_Y261A_L409S_Y410A_P411G_K624I_G640D_T675S_Q735R | + |
| 347 | D141A_E143A_Y261A_L409S_Y410A_P411G_I690V | + |
| 348 | V93Y_D141A_E143A_Y261A_I268F_L409S_Y410A_P411G_Y481T_D671R | ++ |
| 349 | Q91P_V93A_D141A_E143A_Y261A_L409S_Y410A_P411G_D671R | + |
| 350 | D141A_E143A_Y261A_A485L | + |
| 351 | P36G_D141A_E143A_Y261A_L409S_Y410A_P411G | + |
| 352 | D141A_E143A_Y261A_T267W_L409S_Y410A_P411G | + |
| 353 | D141A_E143A_Y261A_L409S_Y410A_P411G_I681T_K683R_E718V_E751K | + |
| 354 | D141A_E143A_Y261A_W355F_L409S_Y410A_P411G | ++ |
| 355 | D141A_E143A_Y261A_L409S_Y410A_P411G_K670R_D671R | ++ |
| 356 | V93Y_D141A_E143A_Y261A_T267Y_L409S_Y410A_P411G_D671R | ++ |
| 357 | D141A_E143A_E251R_Y261A_Y362I_L409F_Y410A_P411A_E663S_V679S_L626 | + |
| 358 | D141A_E143A_Y261A_R269S_L409S_Y410A_P411G | + |
| 359 | V93Y_D141A_E143A_Y261A_T267Y_I268V_L409S_Y410A_P411G_D671R | ++ |
| 360 | D141A_E143A_Y261A_T267Y_L409S_Y410A_P411G | + |
| 361 | D141A_E143A_Y261A_T267A_I268A_L409S_Y410A_P411G | + |
| 362 | D141A_E143A_Y209E_Y261A_L409S_Y410A_P411G | + |

FIG. 139-4

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 363 | V93Y_D141A_E143A_Y261A_T267A_I268A_L409S_Y410A_P411G_D671R | ++ |
| 364 | V93Y_D141A_E143A_Y261A_I268F_L409S_Y410A_P411G_Y481A_D671R | + |
| 365 | V93Y_D141A_E143A_Y261A_L409S_Y410A_P411G_D671R | ++ |
| 366 | D141A_E143A_Y261E_L409S_Y410A_P411G | + |
| 367 | D141A_E143A_Y261A_L409S_Y410A_P411G_T696S | ++ |
| 368 | D141A_E143A_Y261A_L409S_Y410A_P411G_R612E | + |
| 369 | V93Y_D141A_E143A_Y261A_I268V_L409S_Y410A_P411G_Y481A_D671R | ++ |
| 370 | D141A_E143A_Y261A_T267F_L409S_Y410A_P411G | + |
| 371 | D141A_E143A_F230L_T231I_Y261A_L409S_Y410A_P411G | + |
| 372 | D141A_E143A_Q196R_Y261A_L305P_L409S_Y410A_P411G | + |
| 373 | D141A_E143A_Y261A_T267W_I268M_L409S_Y410A_P411G | + |
| 374 | D141A_E143A_Y261A_L409S_Y410A_P411G_V642I | ++ |
| 375 | V93Y_D141A_E143A_Y261A_T267F_L409S_Y410A_P411G_D671R | ++ |
| 376 | D141A_E143A_Y261A_L409S_Y410A_P411G_Y652C_E668G_T675S_I690V | ++ |
| 377 | V93Y_D141A_E143A_Y261A_T267A_L409S_Y410A_P411G_D671R | ++ |
| 378 | D141A_E143A_Y261A_T272Y_L409S_Y410A_P411G_D671R | ++ |
| 379 | D141A_E143A_Y261A_L409S_Y410A_P411G_D671R_T675S | ++ |
| 380 | K118R_D141A_E143A_Y261A_L409S_Y410A_P411G | ++ |

FIG. 139-5

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 381 | V93Y_D141A_E143A_Y261A_T267W_I268W_L409S_Y410A_P411G_D671R | + |
| 382 | D141A_E143A_Y261A_L409S_Y410A_P411G_D720Y | + |
| 383 | D141A_E143A_F214A_Y261A_L409S_Y410A_P411G | ++ |
| 384 | V93Y_D141A_E143A_Y261A_I268Y_L409S_Y410A_P411G_Y481A_D671R | + |
| 385 | D141A_E143A_Y261A_L409S_Y410A_P411G_Y672F | + |
| 386 | V93Y_D141A_E143A_Y261A_T267F_I268V_L409S_Y410A_P411G_D671R | ++ |
| 387 | D141A_E143A_Y261A_L409S_Y410A_P411G_L741Q | + |
| 388 | V93Y_D141A_E143A_Y261A_L409S_Y410A_P411G_D539G_D671R | + |
| 389 | D141A_E143A_Y261A_Q339N_L409S_Y410A_P411G | ++ |
| 390 | D141A_E143A_G211S_G245D_A249V_Y261A_L409S_Y410A_P411G | + |
| 391 | D141A_E143A_Y261A_L409S_Y410A_P411G_G633D | + |
| 392 | Y7F_D141A_E143A_E251R_Y261A_G350S_L409S_Y410A_P411G_D671R | + |
| 393 | V93Y_D141A_E143A_Y261A_I268Y_L409S_Y410A_P411G_D671R | ++ |
| 394 | D141A_E143A_N213Y_L228P_Y261A_M313K_L409S_Y410A_P411G | + |
| 395 | V93F_D141A_E143A_Y261A_L409S_Y410A_P411G_D671R | ++ |
| 396 | D141A_E143A_Y261A_T267V_I268W_L409S_Y410A_P411G | + |
| 397 | V93Y_D141A_E143A_Y261A_I268F_L409S_Y410A_P411G_D671R | ++ |
| 398 | D141A_E143A_Y261A_L275P_L409S_Y410A_P411G_D671R | ++ |

FIG. 139-6

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 399 | D141A_E143A_Y261A_T267W_I268F_L409S_Y410A_P411G | + |
| 400 | D141A_E143A_Y261A_L275M_L409S_Y410A_P411G | ++ |
| 401 | P90M_D141A_E143A_Y261A_L409S_Y410A_P411G | + |
| 402 | D141A_E143A_Y261A_T267M_I268M_L409S_Y410A_P411G | ++ |
| 403 | D141A_E143A_Y261A_L409S_Y410A_P411G_N734R | + |
| 404 | D141A_E143A_Y261A_L409S_Y410A_P411G_E668K | ++ |
| 405 | D141A_E143A_Y146E_H147E_Y261A_L409S_Y410A_P411G | + |
| 406 | D141A_E143A_Y261A_L409S_Y410A_P411G_V642I_V679M_G689S_T696S | ++ |
| 407 | D141A_E143A_Y261A_L409S_Y410A_P411G_K670R | ++ |
| 408 | D141A_E143A_Y261A_L409S_Y410A_P411G_V610K | + |
| 409 | D141A_E143A_Y261A_I268F_L409S_Y410A_P411G | + |
| 410 | D6S_Y7F_D141A_E143A_Y261A_Y362I_L409F_Y410A_P411A_K429R_E663S | + |
| 411 | F116A_D141A_E143A_A261A_L409S_Y410A_P411G | + |
| 412 | D141A_E143A_Y261A | + |
| 413 | D141A_E143A_Y146E_F214A_Y261A_L409S_Y410A_P411G | ++ |
| 414 | V93Y_D141A_E143A_Y146E_Y261A_L409S_Y410A_P411G | ++ |
| 415 | D6S_Y7F_D141A_E143A_E251R_Y261A_L409F_Y410A_P411A_E663S | ++ |
| 416 | V93F_D141A_E143A_Y261A_Y362I_L409F_Y410A_P411A | ++ |

FIG. 139-7

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 417 | D6S_R32(del)_P115S_D141A_E143A_E251R_Y261A_Y362I_L409F_Y410A_P411A_E663S_V679S | ++ |
| 418 | D141A_E143A_Y261A_T267A_I268Y_L409S_Y410A_P411G | + |
| 419 | D141A_E143A_R243E_Y261A_L409S_Y410A_P411G | + |
| 420 | D141A_E143A_Y261A_L409S_Y410A_P411G_R688S | ++ |
| 421 | D141A_E143A_Q242N_Y261A_L409S_Y410A_P411G | ++ |
| 422 | D141A_E143A_Y261A_L409S_Y410A_P411G_E575K_D671R | ++ |
| 423 | D141A_E143A_Y261A_L409S_Y410A_P411G_V645M_K704E | + |
| 424 | V93Y_D141A_E143A_Y261A_I268Y_L409S_Y410A_P411G_Y481W_D671R | + |
| 425 | D141A_E143A_Y261A_T267F_I268M_L409S_Y410A_P411G | + |
| 426 | P115(del)_D141A_E143A_A261A_L409S_Y410A_P411G | + |
| 427 | D141A_E143A_Y261A_L409S_Y410A_P411G_D671R_P677L | ++ |
| 428 | D141A_E143A_Y146E_Y261A_L409S_Y410A_P411G_D671R | ++ |
| 429 | V93Y_D141A_E143A_Y261A_L409S_Y410A_P411G_R612W_D671R | + |
| 430 | D141A_E143A_Y261A_K289Q_L409S_Y410A_P411G_D671R | ++ |
| 431 | D141A_E143A_V205A_Y261A_E276K_L409S_Y410A_P411G | + |
| 432 | D141A_E143A_Y261A_T267M_L409S_Y410A_P411G | + |
| 433 | D141A_E143A_Y261A_T267Y_I268Y_L409S_Y410A_P411G | + |

FIG. 139-8

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 434 | D141A_E143A_Y261A_K289N_L409S_Y410A_P411G_D671R | ++ |
| 435 | D141A_E143A_Y261A_S347T_L409S_Y410A_P411G | ++ |
| 436 | D141A_E143A_Y261A_W355F_L409S_Y410A_P411G_D671R | ++ |
| 437 | D141A_E143A_H147E_Y261A_L409S_Y410A_P411G | ++ |
| 438 | D4A_D141A_E143A_E251A_Y261A_D343R_L409S_Y410A_P411G | + |
| 439 | P36M_D141A_E143A_Y261A_L409S_Y410A_P411G | + |
| 440 | D141A_E143A_Y261A_L409S_Y410A_P411G_K708R | + |
| 441 | D141A_E143A_Y261A_I268W_L409S_Y410A_P411G | + |
| 442 | V93Y_D141A_E143A_Y261A_I268M_L409S_Y410A_P411G_Y481A_D671R | ++ |
| 443 | D141A_E143A_Y261A_L409S_Y410A_P411G_G689S_Y756C | + |
| 444 | V93Y_D141A_E143A_Y261A_I268M_L409S_Y410A_P411G_Y481V_D671R | ++ |
| 445 | D141A_E143A_Y261A_L409S_Y410A_P411G_I732F | ++ |
| 446 | D141A_E143A_M244K_Y261A_V264I_M313L_L409S_Y410A_P411G | + |
| 447 | D141A_E143A_I219V_D246V_A261V_P262S_T267S_L409S_Y410A_P411G | ++ |
| 448 | V93Y_D141A_E143A_Y261A_I268W_L409S_Y410A_P411G_Y481W_D671R | + |
| 449 | D141A_E143A_Y261A_M329A_L409S_Y410A_P411G | + |
| 450 | V93Y_D141A_E143A_Y261A_I268A_L409S_Y410A_P411G_Y481A_D671R | + |

FIG. 139-9

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 451 | Y7F_P115S_D141D_E143E_E251R_Y261A_Y362I_L409F_Y410A_P411A_E663S | + |
| 452 | D141A_E143A_Y261A_L409S_Y410A_P411G_V713I | ++ |
| 453 | V93(del)_D141A_E143A_Y261A_L409S_Y410A_P411G_D671R | + |
| 454 | V93Y_D141A_E143A_Y261A_R407K_L409S_Y410A_P411G_D671R | + |
| 455 | V93Y_D141A_E143A_Y261A_I268V_L409S_Y410A_P411G_Y481F_D671R | + |
| 456 | Y7F_D141A_E143A_L258I_Y261A_Y362I_L409F_Y410A_P411A_E663S | ++ |
| 457 | D141A_E143A_Y261A_L409S_Y410A_P411G_E647K_T666A | ++ |
| 458 | D141A_E143A_Y261A_L409S_Y410A_P411G_I629F_K725R_P738L_D753G | + |
| 459 | V93Y_D141A_E143A_Y261A_T267A_I268M_L409S_Y410A_P411G_D671R | ++ |
| 460 | D141A_E143A_Y261W_L409S_Y410A_P411G | + |
| 461 | D141A_E143A_R199H_T231I_Y261A_A298G_L409S_Y410A_P411G | ++ |
| 462 | D141A_E143A_Y261A_T267V_I268F_L409S_Y410A_P411G | + |
| 463 | V93Y_D141A_E143A_Y261A_T267A_I268V_L409S_Y410A_P411G_D671R | ++ |
| 464 | D141A_E143A_Y261A_K289E_L409S_Y410A_P411G | + |
| 465 | D6S_Y7F_58(del)_D141A_E143A_Y261A_L409F_Y410A_P411A_E663S_V679S | + |
| 466 | K118R_D141A_E143A_Y261A_L409S_Y410A_P411G_D671R | ++ |
| 467 | D141A_E143A_Y261A_Y320F_M329L_L409S_Y410A_P411G | ++ |
| 468 | D141A_E143A_Y261A_L409S_Y410A_P411G_D753G_L754S_E755G_Y756I_Q757S_R758A | + |

FIG. 139-10

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 469 | D141A_E143A_Y146E_Y261A_T274E_L409S_Y410A_P411G | + |
| 470 | D141A_E143A_Y261A_T267A_I268M_L409S_Y410A_P411G | + |
| 471 | D141A_E143A_Y261A_L409S_Y410A_P411G_R611E | + |
| 472 | D141A_E143A_Y261A_L275P_L409S_Y410A_P411G | ++ |
| 473 | D141A_E143A_Y261A_D343A_L409S_Y410A_P411G | ++ |
| 474 | D141A_E143A_Y261A_L409S_Y410A_P411G_P677L | ++ |
| 475 | P115S_D141A_E143A_E251R_Y261A_G350S_Y362I_L409F_Y410A_P411A | + |
| 476 | Y7A_D141A_E143A_A261A_L409S_Y410A_P411G | + |
| 477 | D141A_E143A_Y261A_L409S_Y410A_P411G_I641V | + |
| 478 | D141A_E143A_E224V_L258Q_Y261A_K287R_E332K_L409S_Y410A_P411G | + |
| 479 | D141A_E143A_N213Y_Y261A_T274S_L409S_Y410A_P411G | ++ |
| 480 | Y7F_D141A_E143A_Y261A_Y362I_L409F_Y410A_P411A_E663S_L258 | ++ |
| 481 | D141A_E143A_Y261A_A292T_L409S_Y410A_P411G | + |
| 482 | D141A_E143A_Y261A_D343N_L409S_Y410A_P411G | ++ |
| 483 | D141A_E143A_Y261A_K289E_L409S_Y410A_P411G_D671R | ++ |
| 484 | V93K_D141A_E143A_Y261A_L409S_Y410A_P411G_D671R | + |
| 485 | D141A_E143A_Y261A_N351Q_L409S_Y410A_P411G | ++ |

FIG. 139-11

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 486 | D141A_E143A_Y261A_L409S_Y410A_P411G_I635V_I709F | ++ |
| 487 | D141A_E143A_E251R_Y261A_Y362I_L409F_Y410A_P411A_D671R | + |
| 488 | Y7F_D141A_E143A_Y261A_E251R_L409F_Y410A_P411A | + |
| 489 | D141A_E143A_Y146A_Y261A_L409S_Y410A_P411G | + |
| 490 | D141A_E143A_Y261A_L409S_Y410A_P411G_Y499F_D671R | ++ |
| 491 | D141A_E143A_Y261A_T274W_L409S_Y410A_P411G | + |
| 492 | D141A_E143A_Y261A_I295N_L409S_Y410A_P411G | ++ |
| 493 | D141A_E143A_Y261A_A292N_L409S_Y410A_P411G | + |
| 494 | V93Y_D141A_E143A_Y261A_I268F_L409S_Y410A_P411G_Y481W_D671R | + |
| 495 | D141A_E143A_Y261A_L409S_Y410A_P411G_V610S | + |
| 496 | V93Y_D141A_E143A_Y261A_I268Y_L409S_Y410A_P411G_Y481V_D671R | ++ |
| 497 | Y37F_D141A_E143A_A261A_L409S_Y410A_P411G | + |
| 498 | D141A_E143A_Y261A_L409S_Y410A_P411G_V679M | + |
| 499 | D141A_E143A_Y261A_T272A_L409S_Y410A_P411G | + |
| 500 | D141A_E143A_R247E_Y261A_L409S_Y410A_P411G | + |
| 501 | D141A_E143A_Y261A_L409S_Y410A_P411G_P694R_R712C_Y726F_E755D | ++ |
| 502 | D141A_E143A_Y261A_L409S_Y410A_P411G_Y499F | ++ |

FIG. 139-12

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 503 | V93Y_D141A_E143A_Y261A_I268M_L409S_Y410A_P411G_Y481T_D671R | ++ |
| 504 | D141A_E143A_Y261A_D315E_L409S_Y410A_P411G | + |
| 505 | V93Y_D141A_E143A_Y261A_I268Y_L409S_Y410A_P411G_Y481T_D671R | ++ |
| 506 | D141A_E143A_Y146E_Y261A_D315A_L409S_Y410A_P411G | + |
| 507 | D141A_E143A_Y261A_L409S_Y410A_P411G_T675I | ++ |
| 508 | D141A_E143A_Y261A_T272V_L409S_Y410A_P411G | + |
| 509 | D141A_E143A_F214W_Y261A_L409S_Y410A_P411G | + |
| 510 | D141A_E143A_Y261A_T272L_L409S_Y410A_P411G | + |
| 511 | D6S_Y7F_D141A_E143A_E251R_Y261A_L409S_Y410A_P411G | ++ |
| 512 | Q91K_V93A_D141A_E143A_Y261A_L409S_Y410A_P411G | ++ |
| 513 | D6S_Y7F_V93F_D141A_E143A_Y261A_L409S_Y410A_P411G_E663S | + |
| 514 | D4R_D141A_E143A_E251A_Y261A_D343A_L409S_Y410A_P411G | + |
| 515 | D141A_E143A_E251R_Y261A_G350S_L409S_Y410A_P411G_E663S_A538 | + |
| 516 | D141A_E143A_Y261A_L409S_Y410A_P411G_E616G_Y672F_I690F_H733R | ++ |
| 517 | V93Y_D141A_E143A_Y261A_L409S_Y410A_P411G_D541G_D671R | + |
| 518 | V93Y_D141A_E143A_Y261A_I268A_L409S_Y410A_P411G_Y481T_D671R | ++ |
| 519 | V93Y_D141A_E143A_Y261A_I268W_L409S_Y410A_P411G_Y481F_D671R | + |

FIG. 139-13

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 520 | V93Y_D141A_E143A_G245R_Y261A_L409S_Y410A_P411G_D671R | ++ |
| 521 | D141A_E143A_Y261A_L409S_Y410A_P411G_A638V_E647K_P677L_I732N_R742L_I743E_L744A_E745F_A746G_F747Y_G748K_Y749E_E751D_K752L_D753E_L754Y_E755Q_Y756R_Q757M_R758K | ++ |
| 522 | V93Y_D141A_E143A_Y261A_R407N_L409S_Y410A_P411G_D671R | + |
| 523 | D141A_E143A_Y261A_L409S_Y410A_P411G_E663V_S722G | ++ |
| 524 | D141A_E143A_A190V_Y261A_L409S_Y410A_P411G | + |
| 525 | V93Y_D141A_E143A_Y261A_I268V_L409S_Y410A_P411G_Y481W_D671R | + |
| 526 | D141A_E143A_Y261A_D343R_L409S_Y410A_P411G | ++ |
| 527 | V93Y_D141A_E143A_Y261A_T267W_I268Y_L409S_Y410A_P411G_D671R | ++ |
| 528 | D141A_E143A_Y261A_P262R_L409S_Y410A_P411G_D671R | ++ |
| 529 | D141A_E143A_A190V_Y261A_K285I_M313I_E332K_L409S_Y410A_P411G | ++ |
| 530 | D141A_E143A_Y261A_L409S_Y410A_P411G_R653H | ++ |
| 531 | Q91H_V93F_D141A_Y261A_E143A_L409S_Y410A_P411G_D671R | + |
| 532 | Y7F_D141A_E143A_Y261A_Y362I_L409F_Y410A_P411A | ++ |
| 533 | D141A_E143A_Y261A_M329L_L409S_Y410A_P411G_D671R | ++ |
| 534 | D141A_E143A_Y261A_L409S_Y410A_P411G_A485L | + |
| 535 | D141A_E143A_Y261A_I268F_L409S_Y410A_P411G_D671R | ++ |
| 536 | I114V_D141A_E143A_Y261A_L409S_Y410A_P411G | + |

FIG. 139-14

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 537 | D141A_E143A_Y261A_D315W_L409S_Y410A_P411G | + |
| 538 | D141A_E143A_Y261A_T267F_I268V_L409S_Y410A_P411G | + |
| 539 | D141A_E143A_Y261A_L409S_Y410A_P411G_A739V | + |
| 540 | D141A_E143A_Y209A_Y261A_L409S_Y410A_P411G | + |
| 541 | D141A_E143A_Y261A_L409S_Y410A_P411G_T666A | + |
| 542 | R119T_D141A_E143A_Y261A_L409S_Y410A_P411G | + |
| 543 | D141A_E143A_Y261A_L409S_Y410A_P411G_T675S | + |
| 544 | D141A_E143A_Y261A_L409S_Y410A_P411G_F586I_D671R | ++ |
| 545 | V93Y_D141A_E143A_Y261A_T267F_I268W_L409S_Y410A_P411G_D671R | ++ |
| 546 | P90K_D141A_E143A_Y261A_L409S_Y410A_P411G | + |
| 547 | D141A_E143A_A261A_R265D_L409S_Y410A_P411G | + |
| 548 | V93Y_D141A_E143A_Y261A_L409S_Y410A_P411G_D539A_D541A_D671R | + |
| 549 | D141A_E143A_E251R_Y261A_Y362I_L409F_Y410A_P411A_L626I_E663S_V679S_G748V | + |
| 550 | V93Y_D141A_E143A_Y261A_I268F_L409S_Y410A_P411G_Y481F_D671R | + |
| 551 | D141A_E143A_G245A_Y261A_L409S_Y410A_P411G | + |
| 552 | D141A_E143A_Y261A_L409S_Y410A_P411G_E657V_K707I | ++ |
| 553 | D141A_E143A_Y261A_T267A_I268W_L409S_Y410A_P411G | + |

FIG. 139-15

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 554 | D141A_E143A_Y261A_L275M_L409S_Y410A_P411G_D671R | ++ |
| 555 | D141A_E143A_Y261A_T267A_L409S_Y410A_P411G | + |
| 556 | D6S_Y7F_V93F_D141A_E143A_E251R_Y261A_G350S_L409S_Y410A_P411G_E663S_A309 | + |
| 557 | D141A_E143A_K240E_Y261A_L409S_Y410A_P411G | ++ |
| 558 | D141A_E143A_Y261A_L409S_Y410A_P411G_R667E | + |
| 559 | V93Y_D141A_E143A_G245R_R247D_Y261A_L409S_Y410A_P411G_D671R | + |
| 560 | D141A_E143A_Y261A_I268M_L409S_Y410A_P411G | + |
| 561 | D141A_E143A_Y261A_L409S_Y410A_P411G_E616G_D671R | ++ |
| 562 | D141A_E143A_Y261A_L409S_Y410A_P411G_V713I | + |
| 563 | D141A_E143A_Y261A_T267F_I268F_L409S_Y410A_P411G | + |
| 564 | D141A_E143A_Y261A_Y273W_L409S_Y410A_P411G | + |
| 565 | D141A_E143A_Y261A_L409S_Y410A_P411G_T675A_S699G | ++ |
| 566 | D141A_E143A_Y146S_Y261A_L409S_Y410A_P411G | ++ |
| 567 | D141A_E143A_G233D_M244T_Y261A_L409S_Y410A_P411G | ++ |
| 568 | D141A_E143A_Y261A_T267A_I268V_L409S_Y410A_P411G | ++ |
| 569 | D4R_D141A_E143A_Y261A_L409S_Y410A_P411G | + |
| 570 | D141A_E143A_Y261A_L409S_Y410A_P411G_K673E | ++ |

FIG. 139-16

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 571 | D141A_E143A_Y261A_V290E_L409S_Y410A_P411G | + |
| 572 | V93Y_D141A_E143A_Y261A_L409S_Y410A_P411G_D541A_D671R | + |
| 573 | D141A_E143A_Y261A_L409S_Y410A_P411G_L583P_D671R | ++ |
| 574 | D141A_E143A_P203S_F216L_G227S_A249G_Y261A_V308A_L409S_Y410A_P411G | ++ |
| 575 | D141A_E143A_Y261A_L409S_Y410A_P411G_T675A | + |
| 576 | V93Y_D141A_E143A_Y261A_T267V_L409S_Y410A_P411G_D671R | ++ |
| 577 | V93Y_D141A_E143A_Y261A_T267W_I268M_L409S_Y410A_P411G_D671R | ++ |
| 578 | D141A_E143A_Y261A_L409S_Y410A_P411G_R758H | ++ |
| 579 | D6S_V93F_D141A_E143A_E251R_Y261A_G350S_L409S_Y410A_P411G | + |
| 580 | D141A_E143A_F214V_Y261A_L409S_Y410A_P411G_D671R | ++ |
| 581 | D141A_E143A_Y261A_L409S_Y410A_P411G_I690V_P728S | ++ |
| 582 | Y7F_D141A_E143A_E251R_Y261A_Y362I_L409F_Y410A_P411A_V679S_C-termf | + |
| 583 | V93Y_D141A_E143A_Y261A_T267V_I268V_L409S_Y410A_P411G_D671R | ++ |
| 584 | I114K_D141A_E143A_Y261A_L409S_Y410A_P411G | + |
| 585 | D141A_E143A_Y261A_T267F_I268W_L409S_Y410A_P411G | + |
| 586 | D141A_E143A_Y261A_T267Y_I268F_L409S_Y410A_P411G | + |
| 587 | D141A_E143A_Y146E_Y261A_L409S_Y410A_P411G | ++ |

FIG. 139-17

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 588 | V93Y_D141A_E143A_Y261A_T267M_I268F_L409S_Y410A_P411G_D671R | ++ |
| 589 | D141A_E143A_Y261A_Y320F_L409S_Y410A_P411G | ++ |
| 590 | V93Y_D141A_E143A_Y261A_T267M_L409S_Y410A_P411G_D671R | ++ |
| 591 | V93Y_D141A_E143A_Y261A_I268A_L409S_Y410A_P411G_Y481V_D671R | ++ |
| 592 | D141A_E143A_E251R_Y261A_Y362I_L409F_Y410A_P411A_E663S | + |
| 593 | D141A_E143A_Y261A_L409S_Y410A_P411G_D671R | ++ |
| 594 | R119V_D141A_E143A_Y261A_L409S_Y410A_P411G | + |
| 595 | V93Y_D141A_E143A_Y261A_T267V_I268F_L409S_Y410A_P411G_D671R | ++ |
| 596 | D141A_E143A_Y261A_Y311W_L409S_Y410A_P411G | + |
| 597 | D141A_E143A_Y261A_L409S_Y410A_P411G_L630Q_A680V_E745V | + |
| 598 | Y7F_P14Q_P115S_D141A_E143A_E251R_Y261A_L409S_Y410A_P411G_E663S | ++ |
| 599 | D141A_E143A_E251A_Y261A_L409S_Y410A_P411G | + |
| 600 | D141A_E143A_Y261A_L409S_Y410A_P411G_E663S_V679S | + |
| 601 | D6S_Y7F_D141A_E143A_Y261A_L409S_Y410A_P411G_E663S_V679S | + |
| 602 | V93G_D141A_E143A_Y261A_L409S_Y410A_P411G_D671R | + |
| 603 | D6S_Y7F_D141A_E143A_E251R_Y261A_G350S_Y362I_L409F_Y410A_P411A_E663S_V679S | + |
| 604 | D141A_E143A_Y261A_L409S_Y410A_P411G_G689S | + |

FIG. 139-18

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 605 | Y7F_D141A_E143A_E251R_Y261A_L409F_Y410A_P411A | + |
| 606 | D141A_E143A_Y261A_L409S_Y410A_P411G_E620V_P728S_I743V | ++ |
| 607 | V93Y_D141A_E143A_Y261A_I268A_L409S_Y410A_P411G_Y481F_D671R | + |
| 608 | D141A_E143A_Y261A_Y273A_L409S_Y410A_P411G | + |
| 609 | V93Y_D141A_E143A_R247D_Y261A_L409S_Y410A_P411G_D671R | + |
| 610 | V93Y_D141A_E143A_Y261A_I268Y_L409S_Y410A_P411G_Y481F_D671R | + |
| 611 | D141A_E143A_R247S_Y261A_L409S_Y410A_P411G | + |
| 612 | D141A_E143A_Y261A_L409S_Y410A_P411G_V610A | + |
| 613 | D141A_E143A_Y261A_L409S_Y410A_P411G_R612F | + |
| 614 | D141A_E143A_Y261A_T267V_I268M_L409S_Y410A_P411G | + |
| 615 | D141A_E143A_Y261A_L409S_Y410A_P411G_Q664A | + |
| 616 | D141A_E143A_Y261A_L409S_Y410A_P411G_K670I_G705D | + |
| 617 | V93Y_D141A_E143A_Y261A_I268A_L409S_Y410A_P411G_D671R | ++ |
| 618 | D141A_E143A_Y261A_L409S_Y410A_P411G_V702I_Y749F_E755K | ++ |
| 619 | D4A_D141A_E143A_Y261A_L409S_Y410A_P411G | + |
| 620 | D141A_E143A_Y261A_E332K_L409S_Y410A_P411G | + |
| 621 | V93Y_D141A_E143A_Y261A_T267M_I268M_L409S_Y410A_P411G_D671R | ++ |

FIG. 139-19

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 622 | D141A_E143A_Y261A_A292I_L409S_Y410A_P411G | + |
| 623 | D141A_E143A_Y261A_L409S_Y410A_P411G_Q664L | + |
| 624 | D141A_E143A_Y261A_P262R_L409S_Y410A_P411G | ++ |
| 625 | D141A_E143A_Y261A_L409S_Y410A_P411G_T604S_D671R | ++ |
| 626 | D141A_E143A_Y261A_P262S_T267I_R269H_R307C_L409S_Y410A_P411G | + |
| 627 | D141A_E143A_Y261A_L409S_Y410A_P411G_Q622L_A682T | + |
| 628 | D141A_E143A_D246E_Y261A_V264A_S301N_L409S_Y410A_P411G | ++ |
| 629 | V93S_D141A_E143A_Y261A_L409S_Y410A_P411G_D671R | + |
| 630 | D141A_E143A_G245R_Y261A_L409S_Y410A_P411G_D671R | ++ |
| 631 | D141A_E143A_Y261A_L409S_Y410A_P411G_V610T | ++ |
| 632 | D141A_E143A_Y261A_L409S_Y410A_P411G_E620D_A638T_N651S_K704I_R742C | ++ |
| 633 | D141A_E143A_Y261A_I268A_L409S_Y410A_P411G | + |
| 634 | D141A_E143A_Y261A_L409S_Y410A_P411G_A687T_K707N | ++ |
| 635 | D141A_E143A_Y261A_T272Y_L409S_Y410A_P411G_R612W_D671R | ++ |
| 636 | D141A_E143A_Y261A_L409S_Y410A_P411G_E668G_D671R | ++ |
| 637 | D141A_E143A_E251R_Y261A_G350S_L409S_Y410A_P411G_E663S_V679S_L563 | ++ |
| 638 | D141A_E143A_Y261A_T267M_I268F_L409S_Y410A_P411G | + |

FIG. 139-20

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 639 | D141A_E143A_Y261A_A292N_L409S_Y410A_P411G_D671R | ++ |
| 640 | D141A_E143A_Y261A_M329L_L409S_Y410A_P411G | + |
| 641 | D141A_E143A_Y261A_L409S_Y410A_P411G_E663V_S706C | + |
| 642 | V93Y_D141A_E143A_Y261A_L409S_Y410A_P411G_E577D_D671R | + |
| 643 | V93Y_D141A_E143A_Y261A_T267M_I268V_L409S_Y410A_P411G_D671R | ++ |
| 644 | D141A_E143A_Y261A_R269K_L409S_Y410A_P411G | + |
| 645 | V93Y_D141A_E143A_Y261A_I268W_L409S_Y410A_P411G_D671R | ++ |
| 646 | D141A_E143A_Y261A_R269V_L409S_Y410A_P411G | + |
| 647 | D141A_E143A_F214A_Y261A_L409S_Y410A_P411G_D671R | ++ |
| 648 | Q91N_D141A_E143A_A261A_L409S_Y410A_P411G | + |
| 649 | D141A_E143A_Y261A_L409S_Y410A_P411G_A687S_K725L | ++ |
| 650 | D141A_E143A_Y261A_T267V_L409S_Y410A_P411G | + |
| 651 | Y7F_P14(del)_P115S_D141A_E143A_E251R_Y261A_L409S_Y410A_P411G_E663S | ++ |
| 652 | D141A_E143A_Y218H_Y261A_K286E_E297G_L409S_Y410A_P411G | + |
| 653 | D141A_E143A_Y261A_I268A_L409S_Y410A_P411G_D671R | ++ |
| 654 | V93Y_D141A_E143A_Y261A_I268V_L409S_Y410A_P411G_Y481V_D671R | ++ |
| 655 | D141A_E143A_M244T_Y261A_L409S_Y410A_P411G | ++ |

FIG. 139-21

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 656 | D141A_E143A_Y261A_R269T_L409S_Y410A_P411G | + |
| 657 | D141A_E143A_Y261A_L409S_Y410A_P411G_R742K | + |
| 658 | D141A_E143A_Y261A_L409S_Y410A_P411G_E745V | + |
| 659 | V93Y_D141A_E143A_E251R_Y261A_G350S_L409S_Y410A_P411G_E663S | ++ |
| 660 | D141A_E143A_Y261A_D315R_L409S_Y410A_P411G | + |
| 661 | V93Y_D141A_E143A_Y261A_T267A_I268W_L409S_Y410A_P411G_D671R | ++ |
| 662 | D141A_E143A_Y261A_T267A_I268F_L409S_Y410A_P411G | + |
| 663 | D141A_E143A_Y261A_L409S_Y410A_P411G_E668K_T675S_Q686L_G689S_A739V | ++ |
| 664 | D141A_E143A_Y261A_T267W_I268V_L409S_Y410A_P411G | + |
| 665 | V93Y_D141A_E143A_F214V_Y261A_L409S_Y410A_P411G_D671R | + |
| 666 | D141A_E143A_Y261A_L409S_Y410A_P411G_I617V_E620^ | + |
| 667 | D141A_E143A_Y261A_T267Y_I268M_L409S_Y410A_P411G | + |
| 668 | D141A_E143A_Y261A_L409S_Y410A_P411G_L630M | ++ |
| 669 | V93Y_D141A_E143A_Y261A_Y362I_L409F_Y410A_P411A_V625 | ++ |
| 670 | Y7F_D141A_E143A_E251R_Y261A_Y362I_L409F_Y410A_P411A | + |
| 671 | D141A_E143A_Y261A_Y311A_L409S_Y410A_P411G | ++ |
| 672 | D141A_E143A_Y261A_Y311E_L409S_Y410A_P411G | + |

FIG. 139-22

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 673 | D141A_E143A_Y261A_T267Y_I268W_L409S_Y410A_P411G | + |
| 674 | D141A_E143A_Y261A_L409S_Y410A_P411G_R612W_D671R | ++ |
| 675 | D141A_E143A_Y261A_L409S_Y410A_P411G_K704N | + |
| 676 | V93Y_D141A_E143A_Y261A_T272Y_L409S_Y410A_P411G_D671R | ++ |
| 677 | D141A_E143A_Y261A_T272S_L409S_Y410A_P411G | + |
| 678 | D141A_E143A_I232F_Y261A_A277V_R317C_L409S_Y410A_P411G | + |
| 679 | D141A_E143A_Y261A_L409S_Y410A_P411G_H678Q | + |
| 680 | D141A_E143A_Y261A_L409S_Y410A_P411G_P728S | + |
| 681 | D141A_E143A_Y261A_L409S_Y410A_P411G_K752E | + |
| 682 | D141A_E143A_M244T_Y261A_L409S_Y410A_P411G_D671R | + |
| 683 | D141A_E143A_Y261A_L409S_Y410A_P411G_D671R_T696S | + |
| 684 | D141A_E143A_Y261A_L409S_Y410A_P411G_K507S_D671R | + |
| 685 | D141A_E143A_Y261A_Y320F_L409S_Y410A_P411G_D671R | + |
| 686 | D141A_E143A_Y261A_L409S_Y410A_P411G_E668R | + |
| 687 | D141A_E143A_Y261A | + |
| 688 | V93Y_D141A_E143A_Y261A_L409S_Y410A_P411G_D671R_R758^ | + |
| 689 | D141A_E143A_Y261A_L409S_Y410A_P411G_D671R_A739V | + |

FIG. 139-23

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 690 | D141A_E143A_Y261A_L409S_Y410A_P411G_E529N_D671R | + |
| 691 | D141A_E143A_Y261A_L409S_Y410A_P411G_S699G | + |
| 692 | V93Y_D141A_E143A_Y261A_A292N_L409S_Y410A_P411G_D671R | + |
| 693 | D141A_E143A_Y261A_L409S_Y410A_P411G_D671R_L741Q | + |
| 694 | D141A_E143A_Y261A_L409S_Y410A_P411G_D671R_G689S | + |
| 695 | D141A_E143A_Y261A_L409S_Y410A_P411G_E616G_E668K | ++ |
| 696 | D141A_E143A_Y261A_L409S_Y410A_P411G_D671R_K708R | + |
| 697 | D141A_E143A_Y261A_L409S_Y410A_P411G_R758^ | + |
| 698 | V93Y_D141A_E143A_Y261A_P262R_L409S_Y410A_P411G_D671R | + |
| 699 | V93F_D141A_E143A_Y261A_M329L_L409S_Y410A_P411G_D671R | ++ |
| 700 | D141A_E143A_Y261A_L409S_Y410A_P411G_D671R_V679M | + |
| 701 | D141A_E143A_Y261A_A292N_L409S_Y410A_P411G_E668K | ++ |
| 702 | D141A_E143A_Y261A_L409S_Y410A_P411G_D671R_E745V | + |
| 703 | D141A_E143A_K240E_Y261A_L409S_Y410A_P411G_D671R | + |
| 704 | V93Y_D141A_E143A_Y261A_M329L_L409S_Y410A_P411G_D671R | ++ |
| 705 | V93Y_D141A_E143A_Y261A_L409S_Y410A_P411G_E668K | ++ |
| 706 | D141A_E143A_Y261A_E288K_L409S_Y410A_P411G_D671R | + |

FIG. 139-24

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 707 | V93F_D141A_E143A_Y261A_L409S_Y410A_P411G_E668G_D671R | ++ |
| 708 | V93F_D141A_E143A_Y261A_L409S_Y410A_P411G_E668K_D671R | + |
| 709 | D141A_E143A_Y261A_L409S_Y410A_P411G_R465T | + |
| 710 | V93F_D141A_E143A_Y261A_A292N_L409S_Y410A_P411G_D671R | + |
| 711 | D141A_E143A_Y261A_L409S_Y410A_P411G_D671R_R688S | + |
| 712 | D141A_E143A_Y261A_L409S_Y410A_P411G_Y652M | + |
| 713 | D141A_E143A_Y261A_L409S_Y410A_P411G_D671R_R758^ | + |
| 714 | D141A_E143A_Y261A_E288K_L409S_Y410A_P411G | + |
| 715 | V93Y_D141A_E143A_Y261A_L409S_Y410A_P411G_E668G_D671R | ++ |
| 716 | V93F_D141A_E143A_Y261A_L409S_Y410A_P411G_E668K | ++ |
| 717 | D141A_E143A_Y261A_L409S_Y410A_P411G_K507S | + |
| 718 | D141A_E143A_Y261A_L409S_Y410A_P411G_R465T_D671R | + |
| 719 | D141A_E143A_Y261A_L409S_Y410A_P411G_E668K_R758^ | + |
| 720 | V93Y_D141A_E143A_Y261A_L409S_Y410A_P411G_E668K_D671R | ++ |
| 721 | D141A_E143A_Y261A_L409S_Y410A_P411G_D671R_K752E | + |

FIG. 139-25

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 722 | D141A_E143A_Y261A_L409S_Y410A_P411G_D671R_Q686L | + |
| 723 | D141A_E143A_Y261A_L409S_Y410A_P411G_D671R_I690V | + |
| 724 | D141A_E143A_Y261A_L409S_Y410A_P411G_Q664L_D671R | ++ |
| 725 | D141A_E143A_Y261A_L409S_Y410A_P411G_Y652L | + |

FIG. 139-26

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 726 | D141A_E143A_Y261A_L409S_Y410A_P411G_K487M |
| 727 | P94W_D141A_E143A_Y261A_L409S_Y410A_P411G |
| 728 | D141A_E143Y_Y261A_L409S_Y410A_P411G |
| 729 | D141A_E143A_Y261A_L409S_Y410A_P411G_R612M |
| 730 | Y7F_D141A_E143A_Y261A_L409F_Y410N_P411A_V642A |
| 731 | Y7F_D141A_E143A_Y261A_L409I_Y410M |
| 732 | V93Y_D141A_E143A_Y261A_L409S_Y410A_P411G_E616G_D671R |
| 733 | N11S_D141A_E143A_Y261A_L409S_Y410A_P411G_A485S |
| 734 | D141A_E143A_L409S_Y410A_P411G |
| 735 | V93Y_D141A_E143A_Y261A_L409S_Y410A_P411G_R612G_D671R |
| 736 | D6S_Y7F_D141A_E143A_E251R_Y261A_L409S_Y410A_P411G_E663S_V679S |
| 737 | D141A_E143A_Y261A_L409S_Y410G_Y493I |
| 738 | D141A_E143A_Y261A_L409S_Y410A_P411G_V415K |
| 739 | P90G_D141A_E143A_Y261A_L409S_Y410A_P411G |
| 740 | Y7F_D141A_E143A_Y261A_L409F_Y410M_P411L |
| 741 | Y7F_D141A_E143A_Y261A_L409F_Y410D_P411L |
| 742 | D141A_E143A_Y261A_L409S_Y410A_P411G_E616^ |
| 743 | D141A_E143A_Y410A_Y493I |
| 744 | D141A_E143A_C223V_Y261A_L409S_Y410A_P411G_C509V |

FIG. 140-1

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 745 | D141A_E143A_Y261A_L409F_Y410A_P411G_A485S_Y493I |
| 746 | Y7F_D141A_E143A_Y261A_A485T |
| 747 | Y7F_D141A_E143A_Y261A_L409F_Y410M_P411A |
| 748 | Y7F_D141A_E143A_Y261A_L409F_Y410D |
| 749 | D141A_E143A_Y261A_L333V_L409S_Y410A_P411G |
| 750 | D141A_E143A_Y261A_Y410G_P411G |
| 751 | D141A_E143A_Y261A_L409S_Y410A_P411G_R465^ |
| 752 | D141N_E143A_Y261A_L409S_Y410A_P411G |
| 753 | D141A_E143A_Y261A_L409S_Y410A_P411G_A650V |
| 754 | P90A_D141A_E143A_Y261A_L409S_Y410A_P411G |
| 755 | D6S_Y7F_V93Y_D141A_E143A_E251R_Y261A_Y385R_L409S_Y410A_P411G_E663S |
| 756 | Y7F_D141A_E143A_Y261A_L409N_Y410A |
| 757 | Y7F_D141A_E143A_Y261A_L409F_Y410F_V642A |
| 758 | I54K_L138P_D141A_E143A_Y261A_L409S_Y410A_P411G_A485S |
| 759 | D141A_E143A_Y261A_I268V_L409S_Y410A_P411G |
| 760 | Y7F_D141A_E143A_Y261A_L409L_Y410T |
| 761 | D141A_E143A_Y261A_L409S_Y410A_P411G_D613S |
| 762 | D141A_E143A_Y261A_L409S_Y410A_P411G_D671K |
| 763 | D141A_E143A_L409S_Y493I |

FIG. 140-2

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 764 | Y7F_D141A_E143A_Y261A_L409F_Y410T_P411L_V642A |
| 765 | V93Y_D141A_E143A_Y261A_T272F_L409S_Y410A_P411G_D671R |
| 766 | D141A_E143A_Y261A_L409S_Y410A_P411G_V415T |
| 767 | V93Y_D141A_E143A_Y261A_L409S_Y410A_P411G_R612F_D671R |
| 768 | Y7F_D141A_E143A_Y261A_L409V_Y410F |
| 769 | V93Y_D141A_E143A_N213W_Y261A_L409S_Y410A_P411G_D671R |
| 770 | V93Y_D141A_E143A_Y261A_L409S_Y410A_P411G_Y481T_D671R |
| 771 | D141A_E143L_Y261A_L409S_Y410A_P411G |
| 772 | Y7F_D141A_E143A_Y261A_L409V_Y410D |
| 773 | D141A_E143A_Y410A |
| 774 | V93F_D141A_E143A_Y261A_L409S_Y410A_P411G |
| 775 | E10K_R17H_D141A_E143A_Y146C_Y261A_L409S_Y410A_P411G_A485S |
| 776 | Y7F_D141A_E143A_Y261A |
| 777 | P36A_D141A_E143A_Y261A_L409S_Y410A_P411G |
| 778 | K23M_V68M_K84R_D141A_E143A_Y261A_L409S_Y410A_P411G_A485S |
| 779 | D141A_E143A_Y261A_L409S_Y410A_P411G_E668P |
| 780 | Y7F_K72H_R119H_D141A_E143A_Y362I_Y410A |
| 781 | Y37F_D141A_E143A_Y261A_L409S_Y410A_P411G |
| 782 | Y7F_D141A_E143A_Y261A_L409F_Y410L_V642A |

FIG. 140-3

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 783 | N33S_A40V_G56V_L76Q_H103Y_I122F_D141A_E143A_Y261A_L409S_Y410A_P411G_A485S |
| 784 | Y37N_F87I_D141A_E143A_Y261A_L409S_Y410A_P411G_A485S |
| 785 | D6S_Y7F_P115_D141A_E143A_E251R_Y261A_Y385R_L409S_Y410A_P411G_E663S |
| 786 | V93Y_D141A_E143A_Y261A_T272H_L409S_Y410A_P411G_D671R |
| 787 | V93Y_D141A_E143A_Y261A_L409S_Y410A_P411G_R612H_E616G_D671R |
| 788 | V93Y_D141A_E143A_Y261A_T272L_L409S_Y410A_P411G_D671R |
| 789 | Y7F_I122V_D141A_E143A_Y261A_Y362I_L409A_Y410A_P411A_A485S |
| 790 | I114G_D141A_E143A_Y261A_L409S_Y410A_P411G |
| 791 | D141A_E143A_Y261A_L409S_Y410A_P411G |
| 792 | D141Y_E143A_Y261A_L409S_Y410A_P411G |
| 793 | H103Q_D141A_E143A_Y261A_L409S_Y410A_P411G_A485S |
| 794 | Q91L_V93F_D141A_E143A_Y261A_L409S_Y410A_P411G |
| 795 | D141A_E143A_Y261A_L409S_Y410G_P411V |
| 796 | D141A_E143A_Y261A_L409S_Y410A_P411G_T514A |
| 797 | V93Y_D141A_E143A_Y261A_L409S_Y410A_P411G_Y481V_D671R |
| 798 | Y7F_D141A_E143A_Y261A_L409L_Y410L |
| 799 | F140L_D141A_E143A_R234C_G245D_Y261A_V264I_E288G_E332G_L409S_Y410A_P411G |
| 800 | P36T_D141A_E143A_Y261A_L409S_Y410A_P411G |
| 801 | D141A_E143V_Y261A_L409S_Y410A_P411G |

FIG. 140-4

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 802 | V93Y_D141A_E143A_Y261A_L409S_Y410A_P411G_R612I_D671R |
| 803 | D141A_E143A_Y261A_R265D_L409S_Y410A_P411G |
| 804 | D141A_E143A_Y261A_T267M_I268Y_L409S_Y410A_P411G |
| 805 | V93Y_D141A_E143A_Y261A_L409S_Y410A_P411G_R612H_D671R |
| 806 | D141A_E143A_Y261A_Y410G |
| 807 | V93Y_D141A_E143A_Y261A_T272K_L409S_Y410A_P411G_D671R |
| 808 | D141A_E143A_Y261A_L409S_Y410A_P411G_T762^ |
| 809 | D141A_E143A_Y261A_L409F_Y410A_P411G_A485S |
| 810 | D141A_E143A_Y261A_R269L_L409S_Y410A_P411G |
| 811 | D141A_E143A_C223V_Y261A_L409S_Y410A_P411G_C509V_D648C |
| 812 | V93Y_D141A_E143A_Y261A_L409S_Y410A_P411G_A485T_D671R |
| 813 | V93Y_D141A_E143A_N213E_Y261A_L409S_Y410A_P411G_D671R |
| 814 | Y7F_D141A_E143A_Y362I_Y410A_S492G_Y493I |
| 815 | D141A_E143A_Y261A_L409S_Y410A_P411G_K464^ |
| 816 | D141A_E143A_Y261A_L409S_Y410A_P411G_R611M |
| 817 | D141A_E143A_Y261A_L409S_Y410A_P411G_K673R |
| 818 | V93Y_D141A_E143A_Y261A_L409S_Y410A_P411G_Y481F_D671R |
| 819 | D141A_E143A_Y261A_L409S_Y410A_P411G_D648C |

FIG. 140-5

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 820 | V93Y_D141A_E143A_N213E_F214V_Y261A_L409S_Y410A_P411G_D671R |
| 821 | D141A_E143A_Y261A_L409S_Y410A_P411G_E620D_E632G_N734Y |
| 822 | Y7F_D141A_E143A_Y261A_Y362I_L409A_Y410A_P411A_A485S_S492G_Y493I |
| 823 | D141A_E143A_Y261A_L409S_Y410A_P411G_R612S |
| 824 | V93Y_D141A_E143A_Y261A_T267Y_I268W_L409S_Y410A_P411G_D671R |
| 825 | V93Y_D141A_E143A_Y261A_T272W_L409S_Y410A_P411G_D671R |
| 826 | Y7F_D141A_E143A_Y261A_L409F_Y410F_P411L |
| 827 | D141A_E143A_Y261A_M329S_L409S_Y410A_P411G |
| 828 | D141A_E143A_Y261A_L409S_Y410A_P411G_I488T |
| 829 | E10V_R119H_D141A_E143A_Y261A_L409S_Y410A_P411G_A485S |
| 830 | D141A_E143A_L409S_S492G_Y493I |
| 831 | D141A_E143A_S237G_Y261A_F283L_Y311F_L409S_Y410A_P411G |
| 832 | E10K_R119C_K136E_D141A_E143A_Y261A_L409S_Y410A_P411G_A485S |
| 833 | D141A_E143A_Y261A_T272E_L409S_Y410A_P411G |
| 834 | D141A_E143N_Y261A_L409S_Y410A_P411G |
| 835 | D141A_E143A_Y261A_L409S_Y410A_P411A_T514S |
| 836 | R119A_D141A_E143A_Y261A_L409S_Y410A_P411G |
| 837 | D6S_D141A_E143A_Y261A_Y385R_L409S_Y410A_P411G_V679S |

FIG. 140-6

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 838 | V93Y_D141A_E143A_Y261A_T267F_I268F_L409S_Y410A_P411G_D671R |
| 839 | Y7F_D141A_E143A_Y261A_L409F_Y410F |
| 840 | D141A_E143A_Y261A_T267V_I268V_L409S_Y410A_P411G |
| 841 | V93Y_D141A_E143A_Y261A_I268M_L409S_Y410A_P411G_Y481W_D671R |
| 842 | D141A_E143A_Y261A_L333A_L409S_Y410A_P411G |
| 843 | D141A_E143A_Y261A_L409F_Y410A_P411A_A485S |
| 844 | D141A_E143A_Y261A_Y410G_P411V |
| 845 | Y7F_D141A_E143A_Y261A_L409F_Y410F_P411A |
| 846 | Y7F_D141A_E143A_Y261A_L409F_Y410T_V642A |
| 847 | Y7F_D141A_E143A_Y261A_L409F_Y410F_P411A_V642A |
| 848 | I16T_F87C_D141A_E143A_Y261A_L409S_Y410A_P411G_A485S |
| 849 | Y7F_D141A_E143A_Y261A_L409T_Y410I_V641A |
| 850 | V93Y_D141A_E143A_Y261A_I268A_L409S_Y410A_P411G_Y481W_D671R |
| 851 | D141A_E143A_Y261A_L409S_Y410A_P411G_D671A |
| 852 | D141A_E143A_Y261A_L333I_L409S_Y410A_P411G |
| 853 | V93Y_D141A_E143A_Y261A_T267Y_I268Y_L409S_Y410A_P411G_D671R |
| 854 | Y7F_K72H_R119H_D141A_E143A_Y261A_Y362I_L409A_Y410A_P411A_A485S |
| 855 | V93A_D141A_E143A_Y261A_L409S_Y410A_P411G_D671R |

FIG. 140-7

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 856 | V93Y_D141A_E143A_Y261A_T267A_I268F_L409S_Y410A_P411G_D671R |
| 857 | V93A_D141A_E143A_Y261A_L409S_Y410A_P411G |
| 858 | Y7F_D141A_E143A_Y261A_L409I_Y410F |
| 859 | Y7F_D141A_E143A_Y261A_L409F_Y410F_P411L_V642A |
| 860 | D141A_E143A_C223V_Y261A_L409S_Y410A_P411G_C509V_E620C |
| 861 | D141A_E143A_Y261A_L409S_Y410A_P411A_T514G |
| 862 | D141A_E143A_C223V_Y261A_L409S_Y410A_P411G_C509V_E616C |
| 863 | D141A_E143A_Y261A_I268Y_L409S_Y410A_P411G |
| 864 | Y7F_D141A_E143A_Y261A_L409F_Y410N_V642A |
| 865 | Y7F_D141A_E143A_Y261A_L409F_Y410N_P411L_V642A |
| 866 | P36K_D141A_E143A_Y261A_L409S_Y410A_P411G |
| 867 | D141A_E143A_Y261A_L409S_Y410G_S492G_Y493I |
| 868 | D141A_E143A_Y261A_L409S_Y410A_P411G_K670S |
| 869 | V93Y_D141A_E143A_Y261A_T267Y_I268F_L409S_Y410A_P411G_D671R |
| 870 | D141A_E143A_Y261A_L409S_Y410A_P411G_Q664L_K670R_I690V_K704N |
| 871 | D141A_E143A_Y261A_L409S_Y410A_P411G_E454T |
| 872 | R17C_A40T_D141A_E143A_Y261A_L409S_Y410A_P411G_A485S |
| 873 | Y7F_D141A_E143A_Y261A_L409V_Y410M |

FIG. 140-8

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 874 | V93Y_D141A_E143A_Y261A_T272R_L409S_Y410A_P411G_D671R |
| 875 | D141A_E143A_Q242S_Y261A_L409S_Y410A_P411G |
| 876 | I16T_E25K_D50N_H59Y_V93A_L126Q_D141A_E143A_Y261A_L409S_Y410A_P411G_A485S |
| 877 | V93K_D141A_E143A_Y261A_L409S_Y410A_P411G |
| 878 | Y7F_D141A_E143A_Y261A_L409L_Y410I |
| 879 | D141A_E143A_Y261A_L409S_Y410A_P411G_D671N |
| 880 | R119K_D141A_E143A_Y261A_L409S_Y410A_P411G |
| 881 | D141A_E143A_Y261A_M329W_L409S_Y410A_P411G |
| 882 | Y7F_I122V_D141A_E143A_Y362I_Y410A |
| 883 | Y7F_D141A_E143A_Y261A_L409F_Y410I_P411A |
| 884 | V93Y_D141A_E143A_Y261A_T267F_I268M_L409S_Y410A_P411G_D671R |
| 885 | N33S_R67C_E81V_I100T_D141A_E143A_Y261A_L409S_Y410A_P411G |
| 886 | D141A_E143A_Y261A_L409S_Y410A_P411G_I488M |
| 887 | Y7F_D141A_E143A_Y261A_L409F_Y410M_P411L_V642A |
| 888 | D141A_E143A_Y261A_L409F_Y410A_A485S |
| 889 | D141L_E143A_Y261A_L409S_Y410A_P411G |
| 890 | R119M_D141A_E143A_Y261A_L409S_Y410A_P411G |
| 891 | D141A_E143A_L409S_S492G |
| 892 | I54F_I80F_A105S_D141A_E143A_Y261A_L409S_Y410A_P411G_A485S |
| 893 | D141I_E143A_Y261A_L409S_Y410A_P411G |

FIG. 140-9

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 894 | D141A_E143A_Y261A_L409S_Y410A_P411G_E454N |
| 895 | D141A_E143A_Y261A_L409A_Y410A_P411A_A485S_S492G |
| 896 | Y7F_D141A_E143A_Y362I_Y410A |
| 897 | D141A_E143A_Y261A_T272C_L409S_Y410A_P411G |
| 898 | Y7F_D141A_E143A_Y261A_Y362I_L409F_Y410A_P411G_A485S |
| 899 | Y7F_D141A_E143A_Y261A_L409N_Y410D |
| 900 | V93Y_D141A_E143A_Y261A_T267M_I268W_L409S_Y410A_P411G_D671R |
| 901 | D141A_E143F_Y261A_L409S_Y410A_P411G |
| 902 | D141A_E143A_F214V_Y261A_L409S_Y410A_P411G |
| 903 | F87L_D141A_E143A_Y261A_L409S_Y410A_P411G_A485S |
| 904 | Y7F_D141A_E143A_Y261A_L409I_Y410D |
| 905 | G24S_R119C_D141A_E143A_Y261A_L409S_Y410A_P411G_A485S |
| 906 | D4N_G77S_I96S_P104L_V127M_D141A_E143A_Y261A_L409S_Y410A_P411G_A485S |
| 907 | Y7F_D141A_E143A_Y261A_L409F_Y410M |
| 908 | P94Y_D141A_E143A_Y261A_L409S_Y410A_P411G |
| 909 | V93Y_D141A_E143A_Y261A_T272N_L409S_Y410A_P411G_D671R |
| 910 | D141A_E143A_C223V_Y261A_L409S_Y410A_P411G_R465C_C509V |
| 911 | D141A_E143A_Y261A_L409S_Y410A_P411G_K487R |
| 912 | Y7F_D141A_E143A_Y261A_Y362I_L409S_Y410G |

FIG. 140-10

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 913 | V93Y_D141A_E143A_Y261A_Y385R_L409S_Y410A_P411G_D671R |
| 914 | D141A_E143A_Y261A_L409S_Y410A_P411G_Q686R_Q757H |
| 915 | Y7F_D141A_E143A_Y261A_L409F_Y410I_V642A |
| 916 | D141F_E143A_Y261A_L409S_Y410A_P411G |
| 917 | D141A_E143A_Y261A_L409S_Y410A_P411G_T514G |
| 918 | D141V_E143A_Y261A_L409S_Y410A_P411G |
| 919 | V93Y_D141A_E143A_Y261A_L409S_Y410A_P411G_R612M_D671R |
| 920 | Q91W_D141A_E143A_Y261A_L409S_Y410A_P411G |
| 921 | D141A_E143A_F214A_Y261A_L409S_Y410A_P411G |
| 922 | D6S_V93Y_D141A_E143A_Y261A_Y385R_L409S_Y410A_P411G_V679S |
| 923 | V93Y_D141A_E143A_Y261A_L409S_Y410A_P411G_Y481A_D671R |
| 924 | Q91H_V93Y_D141A_E143A_Y261A_L409S_Y410A_P411G |
| 925 | D141A_E143A_Y261A_L409S_Y410A_P411G_A674T_G689D |
| 926 | D141A_E143A_Y261A_V278M_E288K_L409S_Y410A_P411G |
| 927 | D141A_E143A_Y261A_L409S_Y410A_P411G_I488V |
| 928 | V93Y_P115S_D141A_E143A_Y261A_L409S_Y410A_P411G_E663S |
| 929 | D141A_E143A_S237C_Y261A_L409S_Y410A_P411G |
| 930 | R58C_I109F_K124R_E133K_D141A_E143A_Y261A_L409S_Y410A_P411G_A485S |

FIG. 140-11

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 931 | D141A_E143A_Y261A_L409S_Y410A_P411G_E454D |
| 932 | D141A_E143A_Y261A_V282G_L409S_Y410A_P411G |
| 933 | D141A_E143A_K240E_Y261T_P262L_A292T_L409S_Y410A_P411G |
| 934 | D141A_E143A_Y261A_L409S_Y410A_P411G_E668G |
| 935 | D141A_E143A_Y261A_L409S_Y410A_P411G_A687C |
| 936 | P90L_D141A_E143A_Y261A_L409S_Y410A_P411G_A485S |
| 937 | V93Y_D141A_E143A_Y261A_T267W_I268F_L409S_Y410A_P411G_D671R |
| 938 | Y7F_D141A_E143A_Y261A_L409F_Y410M_P411A_V642A |
| 939 | D141A_E143A_Y261A_L409S_Y410A_P411G_E668D |
| 940 | D141A_E143A_Y261A_L409F_Y410A_P411G_A485S_S492G |
| 941 | D141A_E143A_Y261A_L409F_Y410A_P411G_A485S_S492G_Y493I |
| 942 | D141A_E143I_Y261A_L409S_Y410A_P411G |
| 943 | D141A_E143A_C223V_Y261A_L409S_Y410A_P411G_Y481C_C509V |
| 944 | Y7F_D141A_E143A_Y261A_L409F_Y410D_P411A |
| 945 | Y7F_D141A_E143A_Y261A_L409L_Y410M |
| 946 | D141A_E143A_Y261A_L409S_Y410A_P411G |
| 947 | D141A_E143A_Y261A_L409S_Y410A_P411G_R612N |
| 948 | D141A_E143A_Y261A_V282L_L409S_Y410A_P411G |
| 949 | Y7F_D141A_E143A_Y261A_L409N_Y410N |

FIG. 140-12

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 950 | Y7A_D141A_E143A_Y261A_L409S_Y410A_P411G |
| 951 | D141A_E143A_Y218H_C223S_Y261A_L409S_Y410A_P411G |
| 952 | D141A_E143A_Y261A_L409A_Y410A_T514G |
| 953 | V93G_D141A_E143A_Y261A_L409S_Y410A_P411G |
| 954 | D141A_E143A_Y261A_L409S_Y410G_S492G |
| 955 | V93Y_D141A_E143A_Y261A_T267W_L409S_Y410A_P411G_D671R |
| 956 | D141A_E143A_Y261A_L409S_Y410A_P411G_K673S |
| 957 | Y7F_V82A_L85A_D141A_E143A_Y261A_Y362I_L409A_Y410A_P411A_A485S |
| 958 | I114A_D141A_E143A_Y261A_L409S_Y410A_P411G |
| 959 | V93Y_D141A_E143A_Y261A_T267F_I268Y_L409S_Y410A_P411G_D671R |
| 960 | D141A_E143A_Y261A_L409Y_Y410G_P411V |
| 961 | D141A_E143A_Y261A_L409S_Y410A_P411G_K707G |
| 962 | Y7F_D141A_E143A_Y362I_L409S |
| 963 | D141A_E143A_Y261A_L409S_Y410A_P411G_E475^ |
| 964 | Q91N_D141A_E143A_Y261A_L409S_Y410A_P411G |
| 965 | Y7F_D141A_E143A_Y261A_L409S_Y410A_A485S |
| 966 | V93Y_D141A_E143A_Y261A_T267M_I268Y_L409S_Y410A_P411G_D671R |
| 967 | Y7F_D141A_E143A_Y261A_L409F_Y410I_P411L |
| 968 | R58C_I65F_R107C_M129L_D141A_E143A_Y261A_L409S_Y410A_P411G_A485S |

FIG. 140-13

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 969 | P90V_D141A_E143A_Y261A_L409S_Y410A_P411G |
| 970 | D141A_E143A_Y261A_L409F_Y410G_P411I |
| 971 | V93Y_D141A_E143A_Y261A_K289Q_L409S_Y410A_P411G_D671R |
| 972 | D141A_E143A_Y261A_L409S_Y410A_P411G_E668N |
| 973 | V93(del)_D141A_E143A_Y261A_L409S_Y410A_P411G |
| 974 | D6S_Y7F_D141A_E143A_Y261A_L409F_Y410A_P411A_K429R_E663S |
| 975 | V93Y_D141A_E143A_Y261A_T267V_I268Y_L409S_Y410A_P411G_D671R |
| 976 | D141A_E143A_Y261A_L409S_Y410A_P411G_K487N |
| 977 | Y7F_D141A_E143A_Y261A_L409L_Y410F |
| 978 | D141A_E143A_Y261A_Y410A_P411V |
| 979 | P36V_D141A_E143A_Y261A_L409S_Y410A_P411G |
| 980 | D141A_E143A_Y261A_Y410G_P411A |
| 981 | D141A_E143A_D246L_Y261A_L409S_Y410A_P411G |
| 982 | Y7F_D141A_E143A_Y261A_L409F_Y410T_P411A |
| 983 | D141A_E143A_C223V_Y261A_L409S_Y410A_P411G_C509V_A687C |
| 984 | D141A_E143A_C223V_Y261A_L409S_Y410A_P411G_I474C_C509V |
| 985 | V93Y_D141A_E143A_Y261A_L409S_Y410A_P411G |
| 986 | R97H_F110L_M129V_D141A_E143A_Y261A_L409S_Y410A_P411G_A485S |
| 987 | D4A_D141A_E143A_E251A_Y261A_D343A_L409S_Y410A_P411G |

FIG. 140-14

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 988 | D141A_E143A_Y410A_S492G |
| 989 | D141A_E143A_Y261A_L409A_Y410A_P411A_A485S_Y493I |
| 990 | D141A_E143A_Y261A_Y410A_P411I |
| 991 | D141A_E143A_Y261A_T267M_I268W_L409S_Y410A_P411G |
| 992 | D141A_E143A_Y261A_T267Y_I268V_L409S_Y410A_P411G |
| 993 | D141A_E143A_Y261A_L409S_Y410A_P411G_I488A |
| 994 | Q91L_V93A_D141A_E143A_Y261A_L409S_Y410A_P411G |
| 995 | Y7F_D141A_E143A_Y261A_L409F_Y410D_V642A |
| 996 | D141A_E143A_Y261A_L409S_Y410A_P411G_K673Y |
| 997 | D141A_E143A_C223V_Y261A_L409S_Y410A_P411G_C509V_A623C |
| 998 | V93Y_D141A_E143A_Y261A_S347R_L409S_Y410A_P411G_D671R |
| 999 | D141A_E143A_Y261A_V282T_L409S_Y410A_P411G |
| 1000 | Y7F_D141A_E143A_Y261A_Y362I_L409A_Y410A_P411A_A485S |
| 1001 | D141A_E143A_Y261A_T267V_I268Y_L409S_Y410A_P411G |
| 1002 | D141A_E143A_Y261A_L409S_Y410A_P411G_K693V |
| 1003 | V93Y_D141A_E143A_Y261A_I268W_L409S_Y410A_P411G_Y481T_D671R |
| 1004 | Y7F_D141A_E143A_Y261A_L409F_Y410L_P411A |
| 1005 | D141A_E143A_Y261A_T272R_L409S_Y410A_P411G |

FIG. 140-15

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1006 | Y7F_D141A_E143A_Y261A_L409F_Y410L_P411A_V642A |
| 1007 | D141A_E143A_C223V_Y261A_L409S_Y410A_P411G_K464C_C509V |
| 1008 | F116A_D141A_E143A_Y261A_L409S_Y410A_P411G |
| 1009 | D141A_E143A_Y410A_P411G |
| 1010 | Y7F_D141A_E143A_Y261A_L409I_Y410L |
| 1011 | P90T_D141A_E143A_Y261A_L409S_Y410A_P411G |
| 1012 | D141A_E143A_Y261A_L409S_Y410A_P411G_D671S |
| 1013 | D141A_E143A_Y261A_L409S_Y410A_P411G_I709L |
| 1014 | D141A_E143A_Y261A_Y410A |
| 1015 | Y7F_D141A_E143A_Y261A_L409V_Y410T |
| 1016 | Y7F_D141A_E143A_Y261A_L409F_Y410I |
| 1017 | Y7F_D141A_E143A_Y261A_L409V_Y410L |
| 1018 | V93Y_D141A_E143A_Y261A_I268V_L409S_Y410A_P411G_Y481T_D671R |
| 1019 | D141A_E143A_Y261A_L409S_Y410A_P411G_E668A |
| 1020 | Y7F_D141A_E143A_Y261A_L409F_Y410N_P411A |
| 1021 | V93T_D141A_E143A_Y261A_L409S_Y410A_P411G |
| 1022 | D44G_H59L_W83R_I114T_A117T_D141A_E143A_Y261A_L409S_Y410A_P411G_A485S |
| 1023 | V93Y_D141A_E143A_Y261A_L409S_Y410A_P411G_Y481W_D671R |
| 1024 | D141A_E143A_Y261A_L409S_Y410A_P411G_E668S |
| 1025 | D141A_E143A_Y261A_L409S_Y410A_P411G_I635T_D648G |
| 1026 | D141A_E143A_Y261A_L409S_Y410A_P411G_Y481^ |

FIG. 140-16

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1027 | D141A_E143A_Y261A_L409S_Y410A_P411G_V415R |
| 1028 | V93Y_D141A_E143A_Y261A_T267Y_I268M_L409S_Y410A_P411G_D671R |
| 1029 | Y7F_D141A_E143A_Y261A_L409F_Y410T |
| 1030 | R119G_D141A_E143A_Y261A_L409S_Y410A_P411G |
| 1031 | D141A_E143A_Y261A_L409S_Y410A_P411A_T514A |
| 1032 | D141A_E143A_Y261A_L409S_Y410A_P411G_T514S |
| 1033 | Y7F_D141A_E143A_Y261A_L409I_Y410T |
| 1034 | V93S_D141A_E143A_Y261A_L409S_Y410A_P411G |
| 1035 | V93Y_D141A_E143A_Y261A_L409S_Y410A_P411G_R612L_D671R |
| 1036 | D141A_E143A_Y261A_L409S_Y410A_P411G_I474C |
| 1037 | D141A_E143A_Y261A_L409S_Y410A_P411G_E668M |
| 1038 | D141A_E143A_Y261A_Y362I_L409S_Y410A_P411A |
| 1039 | D141A_E143A_Y410A_S492G_Y493I |
| 1040 | D141A_E143A_D246R_Y261A_L409S_Y410A_P411G |
| 1041 | D141A_E143A_C223V_Y261A_L409S_Y410A_P411G_E475C_C509V |
| 1042 | D141A_E143A_Y261A_L409S_Y410A_P411G_I488S |
| 1043 | Y7F_D141A_E143A_Y261A_L409L_Y410D |

FIG. 140-17

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1044 | E22K_L85Q_D141A_E143A_Y261A_L409S_Y410A_P411G_A485S |
| 1045 | D141A_E143A_Y261A_L409A_Y410A_P411A_A485S_S492G_Y493I |
| 1046 | D141A_E143A_C223V_Y261A_L409S_Y410A_P411G_C509V_Q686C |
| 1047 | D141A_E143A_Y261A_L409S_Y410A_P411G_V415N |
| 1048 | K20E_A117T_G131S_D141A_E143A_Y261A_L409S_Y410A_P411G_A485S |
| 1049 | Y7F_D141A_D143A_Y261A_L409V_Y410L_P411A_A485L |
| 1050 | D141A_E143A_Y261A_L409S_Y410A_P411G_Y652F |
| 1051 | Y7F_D141A_D143A_Y261A_S408G_S412G_A485L |
| 1052 | Y7F_D141A_D143A_Y261A_Y410M_A485L_T514A |
| 1053 | V93Y_D141A_E143A_Y261A_L409S_Y410A_P411G_C509N_S512R_D671R |
| 1054 | D141A_E143A_Y261A_L409S_Y410A_P411G_M770S |
| 1055 | V93Y_D141A_E143A_Y261A_L409S_Y410A_P411G_D671R_Y756^ |
| 1056 | V93Y_D141A_E143A_Y261A_L409S_Y410A_P411G_C509D_S512R_D671R |
| 1057 | D141A_E143A_Y261A_L409S_Y410A_P411G_W767^ |
| 1058 | V93Y_D141A_E143A_Y261A_L409S_Y410A_P411G_C509Q_S512D_D671R |
| 1059 | D141A_E143A_Y261A_L409S_Y410A_P411G_D613Y |
| 1060 | D141A_E143A_C223M_Y261A_L409S_Y410A_P411G_D671R |

FIG. 140-18

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1061 | V93Y_D141A_E143A_Y261A_L409S_Y410A_P411G_S512F_D671R |
| 1062 | D141A_E143A_C223L_Y261A_L409S_Y410A_P411G_D671R |
| 1063 | I80S_V93Y_D141A_E143A_Y261A_L409S_Y410A_P411G_D671R |
| 1064 | Y7F_D141A_D143A_Y261A_L409V_Y410L_P411T_A485L |
| 1065 | V93Y_D141A_E143A_Y261A_L409S_Y410A_P411G_C509N_S512K_D671R |
| 1066 | Y7F_D141A_D143A_Y261A_L409V_Y410A_A485L_T514S |
| 1067 | D141A_E143A_Y261A_L409S_Y410A_P411G_D613E |
| 1068 | Y7F_D141A_D143A_Y261A_A485L_T514A |
| 1069 | D141A_E143A_Y261A_L409S_Y410A_P411G_C509S_D671R |
| 1070 | Y7F_D141A_D143A_Y261A_Y410T_A485L_N491A_T514S |
| 1071 | Y7F_D141A_D143A_Y261A_P411A_A485L |
| 1072 | Y7F_D141A_D143A_Y261A_Y410F_P411T_A485L |
| 1073 | D141A_E143A_Y261A_L409S_Y410A_P411G_M759T |
| 1074 | Y7F_D141A_D143A_Y261A_L409V_Y410L_A485L_T514S |
| 1075 | D141A_E143A_Y261A_L409S_Y410A_P411G_V535S |
| 1076 | Y7F_D141A_D143A_Y261A_L409I_Y410S_A485L_T514A |
| 1077 | Y7F_D141A_D143A_Y261A_Y410L_A485L_T514A |
| 1079 | V93Y_D141A_E143A_Y261A_L409S_Y410A_P411G_C509N_S512W_D671R |

FIG. 140-19

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1080 | Y7F_D141A_D143A_Y261A_L409I_Y410E_P411L_A485L |
| 1081 | Y7F_D141A_D143A_Y261A_Y410T_A485L_T514S |
| 1082 | Y7F_D141A_D143A_Y261A_L409I_Y410M_A485L_T514S |
| 1083 | D141A_E143A_Y261A_L409S_Y410A_P411G_D613A |
| 1084 | Y7F_D141A_D143A_Y261A_S412A_A485L |
| 1085 | Y7F_D141A_D143A_Y261A_Y410T_A485L_T514S_G517V |
| 1086 | D141A_E143A_Y261A_L409S_Y410A_P411G_M759S |
| 1087 | V93Y_D141A_E143A_Y261A_L409S_Y410A_P411G_D671R_M759S |
| 1088 | D141A_E143A_Y261A_L409S_Y410A_P411G_V535R |
| 1089 | Y7F_D141A_D143A_Y261A_P411T_A485L_N491I |
| 1090 | D141A_E143A_Y261A_L409S_Y410A_P411G_V642I_D671R |
| 1091 | V93Y_D141A_E143A_Y261A_L409S_Y410A_P411G_C509D_S512H_D671R |
| 1092 | Y7F_D141A_D143A_Y261A_L409V_Y410L_P411S_A485L |
| 1093 | V93Y_D141A_E143A_Y261A_L409S_Y410A_P411G_C509N_D671R |
| 1094 | V93Y_D141A_E143A_Y261A_L409S_Y410A_P411G_S512D_D671R |
| 1095 | V93Y_D141A_E143A_Y261A_L409S_Y410A_P411G_D671R_Y756K |
| 1096 | Y7F_D141A_D143A_Y261A_P411S_A485L_N491A |

FIG. 140-20

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1097 | Y7F_D141A_D143A_Y261A_Y410L_A485L_T514S |
| 1098 | D141A_E143A_Y261A_L409S_Y410A_P411G_W767F |
| 1099 | Y7F_D141A_D143A_Y261A_A485L_N491T |
| 1100 | V93Y_D141A_E143A_G245S_Y261A_L409S_Y410A_P411G_D671R |
| 1101 | D141A_E143A_Y261A_L409S_Y410A_P411G_Y756^ |
| 1102 | V93Y_D141A_E143A_Y261A_L409S_Y410A_P411G_S512E_D671R |
| 1103 | V93Y_D141A_E143A_Y261A_L409S_Y410A_P411G_S506T_D671R |
| 1104 | Y7F_D141A_D143A_Y261A_L409I_Y410F_A485L_T514A |
| 1105 | Y7F_D141A_D143A_Y261A_Y410S_A485L_T514A |
| 1106 | Y7F_D141A_D143A_Y261A_Y410F_P411S_A485L |
| 1107 | D141A_E143A_K192L_Y261A_L409S_Y410A_P411G_D671R |
| 1108 | V93Y_D141A_E143A_Y261A_L409S_Y410A_P411G_D671R_M759^ |
| 1109 | Y7F_D141A_D143A_Y261A_Y410E_A485L_T514A |
| 1110 | Y7F_D141A_D143A_Y261A_P411V_A485L |
| 1111 | V93Y_D141A_E143A_Y261A_L409S_Y410A_P411G_C509D_S512W_D671R |
| 1112 | Y7F_D141A_D143A_Y261A_Y410T_A485L_V513L |
| 1113 | V93Y_D141A_E143A_Y261A_L409S_Y410A_P411G_D671R_W767Y |
| 1114 | D141A_E143A_Y261A_L409S_Y410A_P411G_W767S |

FIG. 140-21

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1115 | V93Y_D141A_E143A_Y261A_L409S_Y410A_P411G_D671R_M770N |
| 1116 | Y7F_D141A_D143A_Y261A_A485L_Y494W |
| 1117 | Y7F_D141A_D143A_Y261A_L409I_Y410T_A485L_T514A |
| 1118 | V93Y_D141A_E143A_Y261A_L409S_Y410A_P411G_D671R_Y756Q |
| 1119 | D141A_E143A_Y261A_L409S_Y410A_P411G_S506L_D671R |
| 1120 | D141N_E143A_Y261A_M329L_L409S_Y410A_P411G_D671R |
| 1121 | Y7F_D141A_D143A_Y261A_Y410T_A485L_G517A |
| 1122 | V93Y_D141A_E143A_Y261A_L409S_Y410A_P411G_C509Q_S512W_D671R |
| 1123 | Y7F_D141A_D143A_Y261A_L409I_Y410D_A485L_T514S |
| 1124 | V93Y_D141A_E143A_Y261A_L409S_Y410A_P411G_C509Q_S512K_D671R |
| 1125 | Y7F_D141A_D143A_Y261A_L409I_Y410D_A485L_T514A |
| 1126 | Y7F_D141A_D143A_Y261A_P411A_A485L_N491T |
| 1127 | Y7F_D141A_D143A_Y261A_Y410D_A485L_T514S |
| 1128 | Y7F_D141A_D143A_Y261A_L409V_Y410M_A485L_T514A |
| 1129 | D141A_E143A_Y261A_L409S_Y410A_P411G_D613F_D671R |
| 1130 | V93Y_D141A_E143A_C223V_Y261A_L409S_Y410A_P411G_D671R |
| 1131 | D141A_E143A_Y261A_L409S_Y410A_P411G_Y756Q |
| 1132 | V93Y_D141A_E143A_Y261A_L409S_Y410A_P411G_C509H_D671R |

FIG. 140-22

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1133 | D141A_E143A_Y261A_L409S_Y410A_P411G_D613R |
| 1134 | D141A_E143A_Y261A_M329L_L409S_Y410A_P411G_D671R_R758STOP |
| 1135 | Y7F_D141A_D143A_Y261A_A485L_G517A |
| 1136 | Y7F_D141A_D143A_Y261A_Y410F_P411A_A485L |
| 1137 | I80N_V93Y_D141A_E143A_Y261A_L409S_Y410A_P411G_D671R |
| 1138 | D141A_E143N_Y261A_L409S_Y410A_P411G_D671R |
| 1139 | V93F_D141A_E143A_Y261A_P262R_L409S_Y410A_P411G_D671R |
| 1140 | V93Y_D141A_E143A_Y261A_L409S_Y410A_P411G_S506R_D671R |
| 1141 | Y7F_D141A_D143A_Y261A_Y410M_A485L_T514S |
| 1142 | V93Y_D141A_E143A_Y261A_L409S_Y410A_P411G_D671R_M759N |
| 1143 | Y7F_D141A_D143A_Y261A_Y410V_A485L_T514S |
| 1144 | D141A_E143A_Y261A_L409S_Y410A_P411G_M770^ |
| 1145 | D141A_E143A_Y261A_L409S_Y410A_P411G_W767Y |
| 1146 | Y7F_D141A_D143A_Y261A_L409V_Y410F_A485L_T514A |
| 1147 | D141A_E143A_Y261A_L409S_Y410A_P411G_E529N |
| 1148 | D141A_E143A_Y261A_M329L_L409S_Y410A_P411G_E668K |
| 1149 | Y7F_D141A_D143A_Y261A_Y410T_A485L_T514S_G517S |
| 1150 | Y7F_D141A_D143A_Y261A_L409V_Y410L_P411V_A485L |

FIG. 140-23

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1151 | V93Y_D141A_E143A_Y261A_L409S_Y410A_P411G_C509Q_S512H_D671R |
| 1152 | V93Y_D141A_E143A_C223K_Y261A_L409S_Y410A_P411G_D671R |
| 1153 | Y7F_D141A_D143A_Y261A_Y410T_A485L_T514S_G517T |
| 1154 | D141A_E143A_Y261A_L409S_Y410A_P411G_D613S_D671R |
| 1155 | I80R_V93Y_D141A_E143A_Y261A_L409S_Y410A_P411G_D671R |
| 1156 | D141A_E143A_Y261A_L409S_Y410A_P411G_Q497M_D671R |
| 1157 | Y7F_D141A_D143A_Y261A_Y410F_A485L_T514S |
| 1158 | Y7F_D141A_D143A_Y261A_L409V_Y410T_A485L_T514A |
| 1159 | D141A_E143A_Y261A_L409S_Y410A_P411G_Y652C |
| 1160 | V93Y_D141A_E143A_Y261A_L409S_Y410A_P411G_S506A_D671R |
| 1161 | V93Y_D141A_E143A_Y261A_L409S_Y410A_P411G_D671R_M770T |
| 1162 | V93Y_D141A_E143A_G245K_Y261A_L409S_Y410A_P411G_D671R |
| 1163 | D141A_E143A_Y261A_L409S_Y410A_P411G_D613N |
| 1164 | V93Y_D141A_E143A_Y261A_L409S_Y410A_P411G_V535K_D671R |
| 1165 | Y7F_D141A_D143A_Y261A_L409V_Y410S_A485L_T514S |
| 1166 | Y7F_D141A_D143A_Y261A_S408A_S412A_A485L |
| 1167 | Y7F_D141A_D143A_Y261A_P411T_A485L |
| 1168 | I80N_D141A_E143A_Y261A_L409S_Y410A_P411G |

FIG. 140-24

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1169 | D141A_E143A_Y261A_L409S_Y410A_P411G_D613F |
| 1170 | D141A_E143A_G245N_Y261A_L409S_Y410A_P411G |
| 1171 | Y7F_D141A_D143A_Y261A_L409I_Y410L_A485L_T514A |
| 1172 | Y7F_D141A_D143A_Y261A_Y410F_P411V_A485L |
| 1173 | Y7F_D141A_D143A_Y261A_Y410A_A485L_T514A |
| 1174 | Y7F_D141A_D143A_Y261A_Y410T_A485L_V513I_T514S |
| 1175 | Y7F_D141A_D143A_Y261A_L409V_Y410A_A485L_T514A |
| 1176 | Y7F_D141A_D143A_Y261A_A485L_V513M |
| 1177 | V93Y_D141A_E143A_Y261A_L409S_Y410A_P411G_K534N_D671R |
| 1178 | Y7F_D141A_D143A_Y261A_Y410A_A485L_T514S |
| 1179 | Y7F_D141A_D143A_Y261A_Y410T_A485L_T514A |
| 1180 | D141A_E143A_Y261A_L409S_Y410A_P411G_D613E_D671R |
| 1181 | D141A_E143A_Y261A_L409S_Y410A_P411G_M770T |
| 1182 | V93Y_D141A_E143A_C223P_Y261A_L409S_Y410A_P411G_D671R |
| 1183 | Y7F_D141A_D143A_Y261A_A485L_N491S |
| 1184 | D141A_E143A_Y261A_L409S_Y410A_P411G_M770N |
| 1185 | Y7F_D141A_D143A_Y261A_Y410T_A485L_V513M |
| 1186 | V93Y_D141A_E143A_Y261A_L409S_Y410A_P411G_C509D_S512F_D671R |

FIG. 140-25

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1187 | V93Y_D141A_E143A_Y261A_L409S_Y410A_P411G_C509N_S512F_D671R |
| 1188 | Y7F_D141A_D143A_Y261A_A485L_G517V |
| 1189 | Y7F_D141A_D143A_Y261A_Y410T_A485L_G517V |
| 1190 | D141A_E143A_Y261A_L409S_Y410A_P411G_D613A_D671R |
| 1191 | D141A_E143A_Y261A_L409S_Y410A_P411G_M759N |
| 1192 | V93Y_D141A_E143A_Y261A_L409S_Y410A_P411G_K534S_D671R |
| 1193 | Y7F_D141A_D143A_Y261A_A485L |
| 1194 | Y7F_D141A_D143A_Y261A_A485L_N491A |
| 1195 | D141A_E143A_G245K_Y261A_L409S_Y410A_P411G |
| 1196 | Y7F_D141A_D143A_Y261A_A485L_V513A |
| 1197 | V93Y_D141A_E143A_Y261A_L409S_Y410A_P411G_D671R_M770S |
| 1198 | Y7F_D141A_D143A_Y261A_Y410T_A485L_V513M_T514S |
| 1199 | D141A_E143A_Y261A_L409S_Y410A_P411G_D613V |
| 1200 | V93Y_D141A_E143A_Y261A_L409S_Y410A_P411G_D671R_W767^ |
| 1201 | Y7F_D141A_D143A_Y261A_L409I_Y410A_A485L_T514A |
| 1202 | V93Y_D141A_E143A_Y261A_L409S_Y410A_P411G_V535R_D671R |
| 1203 | D141A_E143A_C223A_Y261A_L409S_Y410A_P411G_D671R |
| 1204 | Y7F_D141A_D143A_Y261A_Y410T_A485L_G517T |

FIG. 140-26

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1205 | D141A_E143A_Y261A_Y362I_L409S_Y410A_P411G_D671R |
| 1206 | Y7F_D141A_D143A_Y261A_L409V_Y410M_A485L_T514S |
| 1207 | V93Y_D141A_E143A_Y261A_L409S_Y410A_P411G_C509N_S512H_D671R |
| 1208 | Y7F_D141A_D143A_Y261A_L409V_Y410E_A485L_T514S |
| 1209 | Y7F_D141A_D143A_Y261A_L409V_Y410E_A485L_T514A |
| 1210 | V93Y_D141A_E143A_Y261A_L409S_Y410A_P411G_C509D_S512K_D671R |
| 1211 | V93Y_D141A_E143A_C223D_Y261A_L409S_Y410A_P411G_D671R |
| 1212 | D141A_E143A_Y261A_L409S_Y410A_P411G_A650T_D671R |
| 1213 | V93Y_D141A_E143A_G245N_Y261A_L409S_Y410A_P411G_D671R |
| 1214 | Y7F_D141A_D143A_Y261A_L409I_Y410T_A485L_T514S |
| 1215 | Y7F_D141A_D143A_Y261A_L409V_Y410T_A485L_T514S |
| 1216 | V93Y_D141A_E143A_Y261A_L409S_Y410A_P411G_C509D_D671R |
| 1217 | Y7F_D141A_D143A_Y261A_P411V_A485L_N491S |
| 1218 | D141A_E143A_Y261A_L409S_Y410A_P411G_M759^ |
| 1219 | Y7F_D141A_D143A_Y261A_Y410L_P411A_A485L |
| 1220 | Y7F_D141A_D143A_Y261A_L409V_Y410F_A485L_T514S |
| 1221 | Y7F_D141A_D143A_Y261A_L409V_Y410S_A485L_T514A |

FIG. 140-27

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1222 | Y7F_D141A_D143A_Y261A_Y410T_A485L_V513F_T514S |
| 1223 | D141A_E143V_Y261A_L409S_Y410A_P411G_D671R |
| 1224 | Y7F_D141A_D143A_Y261A_A485L_G517S |
| 1225 | Y7F_D141A_D143A_Y261A_L409I_Y410A_A485L_T514S |
| 1226 | D141A_E143A_Y261A_A298G_L409S_Y410A_P411G_D671R |
| 1227 | Y7F_D141A_D143A_Y261A_Y410T_A485L_N491S_T514S |
| 1228 | Y7F_D141A_D143A_Y261A_Y410F_A485L_T514A |
| 1229 | Y7F_D141A_D143A_Y261A_A485L_T514S |
| 1230 | D141N_E143V_Y261A_L409S_Y410A_P411G |
| 1231 | Y7F_D141A_D143A_Y261A_Y410T_A485L_V513I |
| 1232 | V93Y_D141A_E143A_Y261A_L409S_Y410A_P411G_C509Q_S512R_D671R |
| 1233 | D141A_E143A_Y261A_L409S_Y410A_P411G_K534S |
| 1234 | Y7F_D141A_D143A_Y261A_L409I_Y410V_A485L_T514A |
| 1235 | Y7F_D141A_D143A_Y261A_A485L_N491I |
| 1236 | D141A_E143A_Y261A_L409S_Y410A_P411G_D613Y_D671R |
| 1237 | D141A_E143A_Y261A_V282L_L409S_Y410A_P411G_D671R |
| 1238 | Y7F_D141A_D143A_Y261A_A485L_Y493W |
| 1239 | D141A_E143A_Y261A_L409S_Y410A_P411G_C509M_D671R |
| 1240 | Y7F_D141A_D143A_Y261A_Y410E_A485L_T514S |

FIG. 140-28

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1241 | Y7F_D141A_D143A_Y261A_Y410D_A485L_T514A |
| 1242 | D141A_E143A_C223S_Y261A_L409S_Y410A_P411G_D671R |
| 1243 | Y7F_D141A_D143A_Y261A_A485L_T514I |
| 1244 | Y7F_D141A_D143A_Y261A_A485L_Y494F |
| 1245 | D141N_E143N_Y261A_L409S_Y410A_P411G |
| 1246 | D141A_E143A_Y261A_L409S_Y410A_P411G_V535N |
| 1247 | D141A_E143A_G245R_Y261A_L409S_Y410A_P411G |
| 1248 | Y7F_D141A_D143A_Y261A_L409V_Y410D_A485L_T514S |
| 1249 | Y7F_D141A_D143A_Y261A_A485L_G517T |
| 1250 | D141N_E143A_Y261A_L409S_Y410A_P411G_D671R |
| 1251 | D141A_E143A_Y261A_L409S_Y410A_P411G_D613N_D671R |
| 1252 | D141A_E143A_Y261A_L409S_Y410A_P411G_D613R_D671R |
| 1253 | Y7F_D141A_D143A_Y261A_Y410L_P411V_A485L |
| 1254 | Y7F_D141A_D143A_Y261A_A485L_V513I |
| 1255 | V93Y_D141A_E143A_Y261A_L409S_Y410A_P411G_K534R_D671R |
| 1256 | Y7F_D141A_D143A_Y261A_P411S_A485L |
| 1257 | I80S_D141A_E143A_Y261A_L409S_Y410A_P411G |
| 1258 | Y7F_D141A_D143A_Y261A_L409V_Y410V_A485L_T514A |
| 1259 | I80K_V93Y_D141A_E143A_Y261A_L409S_Y410A_P411G_D671R |

FIG. 140-29

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1260 | V93Y_D141A_E143A_Y261A_L409S_Y410A_P411G_V535N_D671R |
| 1261 | I80R_D141A_E143A_Y261A_L409S_Y410A_P411G |
| 1262 | Y7F_D141A_D143A_Y261A_L409I_Y410E_A485L_T514S |
| 1263 | Y7F_D141A_D143A_Y261A_L409I_Y410S_A485L_T514S |
| 1264 | D141A_E143A_Y261A_L409S_Y410A_P411G_D613V_D671R |
| 1265 | V93Y_D141A_E143A_Y261A_L409S_Y410A_P411G_D671R_W767F |
| 1266 | D141A_E143A_Y261A_L409S_Y410A_P411G_S506R_D671R |
| 1267 | I80K_D141A_E143A_Y261A_L409S_Y410A_P411G |
| 1268 | D141A_E143A_Y261A_L409S_Y410A_P411G_V535K |
| 1269 | V93Y_D141A_E143A_Y261A_L409S_Y410A_P411G_D671R_W767H |
| 1270 | D141A_E143A_Y261A_L409S_Y410A_P411G_S506A_D671R |
| 1271 | Y7F_D141A_D143A_Y261A_Y410T_A485L_G517S |
| 1272 | Y7F_D141A_D143A_Y261A_A485L_V513F |
| 1273 | Y7F_D141A_D143A_Y261A_L409V_Y410V_A485L_T514S |
| 1274 | D141A_E143A_Y261A_L409S_Y410A_P411G_V419I_D671R |
| 1275 | D141A_E143A_Y261A_L409S_Y410A_P411G_D613K |
| 1276 | Y7F_D141A_D143A_Y261A_L409V_Y410L_A485L_T514A |
| 1277 | V93Y_D141A_E143A_Y261A_L409S_Y410A_P411G_C509D_S512D_D671R |

FIG. 140-30

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1278 | Y7F_D141A_D143A_Y261A_A485L_V513S |
| 1279 | V93Y_D141A_E143A_C223N_Y261A_L409S_Y410A_P411G_D671R |
| 1280 | Y7F_D141A_D143A_Y261A_Y410L_P411S_A485L |
| 1281 | Y7F_D141A_D143A_Y261A_Y410S_A485L_T514S |
| 1282 | Y7F_D141A_D143A_Y261A_A485L_T514V |
| 1283 | D141A_E143A_Y261A_L409S_Y410A_P411G_D613Q_D671R |
| 1284 | D141A_E143A_Y261A_L409S_Y410A_P411G_Q497N_D671R |
| 1285 | Y7F_D141A_D143A_Y261A_I413V_A485L |
| 1286 | D141A_E143A_Y261A_L409S_Y410A_P411G_D613Q |
| 1287 | V93Y_D141A_E143A_Y261A_L409S_Y410A_P411G_C509Q_S512F_D671R |
| 1288 | Y7F_D141A_D143A_Y261A_Y410T_A485L_V513L_T514S |
| 1289 | Y7F_D141A_D143A_Y261A_L409V_Y410D_A485L_T514A |
| 1290 | Y7F_D141A_D143A_Y261A_L409I_Y410E_A485L_T514A |
| 1291 | Y7F_D141A_D143A_Y261A_Y410V_A485L_T514A |
| 1292 | Y7F_D141A_D143A_Y261A_S412G_A485L |
| 1293 | V93Y_D141A_E143A_Y261A_L409S_Y410A_P411G_D671R_M759T |
| 1294 | Y7F_D141A_D143A_Y261A_Y410T_A485L_N491T_T514S |
| 1295 | D141A_E143A_Y261A_L409S_Y410A_P411G_D613K_D671R |

FIG. 140-31

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1296 | Y7F_D141A_D143A_Y261A_L409I_Y410V_A485L_T514S |
| 1297 | V93Y_D141A_E143A_Y261A_L409S_Y410A_P411G_V535S_D671R |
| 1298 | D141A_E143A_Y261A_V282L_M329L_L409S_Y410A_P411G_D671R |
| 1299 | Y7F_D141A_D143A_Y261A_Y410T_A485L_N491I_T514S |
| 1300 | D141A_E143A_Y261A_L409S_Y410A_P411G_W767H |
| 1301 | Y7F_D141A_D143A_Y261A_Y410L_P411T_A485L |
| 1302 | V93Y_D141A_E143A_Y261A_L409S_Y410A_P411G_C509N_S512D_D671R |
| 1303 | Y7F_D141A_D143A_Y261A_Y410T_A485L_T514S_G517A |
| 1304 | D141A_E143A_Y261A_L409S_Y410A_P411G_S506T_D671R |
| 1305 | Y7F_D141A_D143A_Y261A_L409I_Y410M_A485L_T514A |
| 1306 | D141A_E143A_Y261A_L409S_Y410A_P411G_C509A_D671R |
| 1307 | Y7F_D141A_D143A_Y261A_S408A_A485L |
| 1308 | Y7F_D141A_D143A_Y261A_L409I_Y410F_A485L_T514S |
| 1309 | Y7F_D141A_D143A_Y261A_S408G_A485L |
| 1310 | V93Y_D141A_E143A_Y261A_L409S_Y410A_P411G_D671R_W767S |
| 1311 | V93Y_D141A_E143A_Y261A_L409S_Y410A_P411G_D671R_M770^ |

FIG. 140-32

Table 3: Wild type RLF 89458.1 = SEQ ID NO:1; wild type RLF 78286 = SEQ ID NO:2

| SEQ# | Mutations based on SEQ ID NOS: 1 or 2 |
|---|---|
| 1312 | Y7F_D141A_D143A_Y261A_L409I_Y410L_A485L_T514S |
| 1313 | Y7F_D141A_D143A_Y261A_Y410T_A485L_V513F |
| 1314 | Y7F_D141A_D143A_Y261A_A485L_Y493F |
| 1315 | V93Y_D141A_E143A_Y261A_L409S_Y410A_P411G_S Table 4: Wild type NOZ 58130 = SEQ ID NO:1316

| SEQ# | Mutations based on SEQ ID NO:1316 | Incorp'n |
|---|---|---|
| 1317 | Y14F_D168A_E170A_L440Y_Y441G | ++ |
| 1318 | D168A_E170A_L440S_Y441A | + |
| 1319 | Y14F_D168A_E170A_L440Y_Y441A_P442G | + |
| 1320 | D168A_E170A_L440F_Y441A_P442G | + |
| 1321 | Y14F_D168A_E170A_L440Y_Y441A | + |
| 1322 | D168A_E170A_L440Y_Y441A_P442G | + |
| 1323 | Y14F_D168A_E170A_L440F_Y441A_P442G | + |
| 1324 | D168A_E170A_L440F_Y441G | + |
| 1325 | Y14F_D168A_E170A_L440F_Y441G | + |
| 1326 | D168A_E170A_L440Y_Y441A | + |
| 1327 | Y14F_D168A_E170A_L440S_Y441A | + |
| 1328 | Y14F_D168A_E170A_L440A_Y441A_P442A | + |
| 1329 | D168A_E170A_L440A_Y441A_P442A | + |
| 1330 | Y14N_R122S_R150A_D168A_E170A_L440F_Y441G_I480Y_R496T_R537S_E559N | ++ |
| 1331 | Y14F_D168A_E170A_K319V_L440F_Y441G | ++ |
| 1332 | Y14F_D168V_E170L_C362V_L440F_Y441G_C539V_V543S | + |
| 1333 | Y14F_D168A_E170A_K319R_C362L_L440F_Y441G | + |
| 1334 | Y14F_D168A_E170A_C362V_L440F_Y441G_C539V | + |
| 1335 | Y14F_D168V_E170L_C362V_F440H_Y441G_C539V | + |
| 1336 | Y14F_D168A_E170A_L440F_Y441G_V566S | + |
| 1337 | Y14F_D168A_E170A_C362L_Y408R_L440F_Y441G | + |
| 1338 | Y14F_D168V_E170L_C362V_Y441G_C539V_I551V | + |
| 1339 | Y14N_R122S_E157F_D168A_E170A_E331N_L440F_Y441G_R496T_R537S_E559N | ++ |

FIG. 141-1

Table 4: Wild type NOZ 58130 = SEQ ID NO:1316

| SEQ# | Mutations based on SEQ ID NOS: 1316 | Incorp'n |
|---|---|---|
| 1340 | Y14D_R122S_D168A_E170A_C362L_L440F_Y441G_R496T_A515T_R537S_E559K | ++ |
| 1341 | Y14F_W135L_D168A_E170A_C362L_L440F_Y441G | + |
| 1342 | Y14N_R122S_R150A_D168A_E170A_L440F_Y441G_R537S_E559N | ++ |
| 1343 | Y14N_R122S_E157F_D168A_E170A_L440F_Y441G_R537S_E559N | ++ |
| 1344 | Y14D_R122S_D168A_E170A_V298I_L440F_Y441G_R496T_A515T_R537S_E559K | ++ |
| 1345 | Y14F_D168A_E170A_C362L_L440F_Y441G_Q785^ | + |
| 1346 | Y14F_D168A_E170A_L440F_Y441G_W791R_F792R | + |
| 1347 | Y14N_R122S_R150V_D168A_E170A_E331N_L440F_Y441G_R496T_R537S_E559K | ++ |
| 1348 | Y14N_R122S_R150A_D168V_E170V_L440F_Y441G_R496T_R537S_E559N | ++ |
| 1349 | Y14F_D168A_E170A_D330E_L440F_Y441G | + |
| 1350 | Y14F_D168V_E170L_C362V_F440I_Y441G_C539V | + |
| 1351 | Y14N_R122S_R150V_D168A_E170A_L440F_Y441G_R537S_E559K | ++ |
| 1352 | Y14F_W135R_D168A_E170A_C362L_L440F_Y441G | + |
| 1353 | Y14F_D168A_E170A_L440F_Y441G_V566R | + |
| 1354 | Y14F_D168A_E170A_C362L_L440F_Y441G_F523Y | + |
| 1355 | Y14F_D168A_E170A_L440F_Y441G_E565R | ++ |
| 1356 | Y14N_R122S_R150V_D168A_E170A_L440F_Y441G_I480Y_R496T_R537S_E559K | + |
| 1357 | Y14N_R122S_E157F_D168A_E170A_C362L_L440F_Y441G_R496T_R537S_E559N | ++ |

FIG. 141-2

Table 4: Wild type NOZ 58130 = SEQ ID NO:1316

| SEQ# | Mutations based on SEQ ID NOS: 1316 | Incorp'n |
|---|---|---|
| 1358 | Y14N_R122S_R150A_D168A_E170A_L313M_L440F_Y441G_R496T_R537S_E559N | ++ |
| 1359 | Y14F_D168V_E170L_C362V_F440V_Y441G_C539V | + |
| 1360 | Y14F_V121A_D168A_E170A_L440F_Y441G | + |
| 1361 | Y14D_R122S_D168A_E170A_E331N_L440F_Y441G_R496T_A515T_R537S_E559K | ++ |
| 1362 | Y14N_R122S_R150V_D168A_E170A_L313M_L440F_Y441G_R496T_R537S_E559K | ++ |
| 1363 | Y14N_R122S_R150A_D168A_E170A_L440F_Y441G_I480F_R496T_R537S_E559N | ++ |
| 1364 | Y14F_P83R_D168A_E170A_C362L_L440F_Y441G | + |
| 1365 | Y14F_D168A_E170A_L440F_Y441G_V566K | + |
| 1366 | Y14F_D168A_E170A_G275R_L440F_Y441G | + |
| 1367 | Y14F_D168V_E170L_C362V_S439G_L440F_Y441G_C539V | 0 |
| 1368 | Y14N_R122S_E157F_D168A_E170A_V298I_L440F_Y441G_R496T_R537S_E559N | ++ |
| 1369 | Y14F_D168A_E170A_A352E_C362L_L440F_Y441G | + |
| 1370 | Y14F_D168A_E170A_L440F_Y441G_L585K | + |
| 1371 | Y14F_D168A_E170A_C362L_L440F_Y441G_M723N | + |
| 1372 | Y14F_D168V_E170L_C362V_L440F_Y441G_C539V_V543G | 0 |
| 1373 | Y14F_D168A_E170A_L440F_Y441G_E565N | + |
| 1374 | Y14F_R84K_D168A_E170A_L440F_Y441G | ++ |
| 1375 | Y14N_R122S_E157F_D168A_E170A_L313M_L440F_Y441G_R496T_R537S_E559N | ++ |
| 1376 | Y14F_D168V_E170L_C362V_S439A_L440F_Y441G_S443A_C539V | 0 |

FIG. 141-3

Table 4: Wild type NOZ 58130 = SEQ ID NO:1316

| SEQ# | Mutations based on SEQ ID NOS: 1316 | Incorp'n |
|---|---|---|
| 1377 | Y14F_D168A_E170A_C362L_L440F_Y441G_W791R_F792R | + |
| 1378 | Y14F_R84N_D168A_E170A_L440F_Y441G | ++ |
| 1379 | Y14F_D168A_E170A_F326A_L440F_Y441G | + |
| 1380 | Y14F_D168A_E170A_A352D_L440F_Y441G | ++ |
| 1381 | Y14N_R122S_R150V_D168A_E170A_L440F_Y441G_I480F_R496T_R537S_E559K | ++ |
| 1382 | Y14F_D168V_E170L_C362V_L440F_Y441G_S443G_C539V | 0 |
| 1383 | Y14F_D168V_E170L_C362V_Y441G_I445F_C539V | + |
| 1384 | Y14F_D168A_E170A_C362L_L440F_Y441G_D777^ | + |
| 1385 | Y14N_R122S_E157F_D168V_E170V_L440F_Y441G_R496T_R537S_E559N | ++ |
| 1386 | Y14D_R122S_D168V_E170V_L440F_Y441G_R496T_A515T_R537S_E559K | ++ |
| 1387 | Y14F_D168A_E170A_L440F_Y441G_W791R_F792^ | + |
| 1388 | Y14F_D168A_E170A_A352E_L440F_Y441G | ++ |
| 1389 | Y14N_R122S_R150V_D168A_E170A_V298I_L440F_Y441G_R496T_R537S_E559K | ++ |
| 1390 | Y14F_D168A_E170A_L440F_Y441G_E565K | + |
| 1391 | Y14F_D168A_E170A_F326A_C362L_L440F_Y441G | + |
| 1392 | Y14F_D168V_E170L_C362V_L440F_Y441G_C539V_V543A | + |
| 1393 | Y14F_D168A_E170A_T327Q_L440F_Y441G | + |
| 1394 | Y14F_D168A_E170A_C362L_L440F_Y441G_M723^ | 0 |
| 1395 | Y14F_D168V_E170L_C362V_S439G_L440F_Y441G_S443G_C539V | 0 |

FIG. 141-4

Table 4: Wild type NOZ 58130 = SEQ ID NO:1316

| SEQ# | Mutations based on SEQ ID NOS: 1316 | Incorp'n |
|---|---|---|
| 1396 | Y14F_D168A_E170A_D321F_L440F_Y441G | + |
| 1397 | Y14F_E76N_D168A_E170A_L440F_Y441G | ++ |
| 1398 | Y14N_R122S_R150V_D168V_E170V_L440F_Y441G_R496T_R537S_E559K | ++ |
| 1399 | Y14F_R84S_D168A_E170A_L440F_Y441G | + |
| 1400 | Y14F_D168A_E170A_V288F_L440F_Y441G | ++ |
| 1401 | Y14F_D168V_E170L_C362V_Y441G_F511L_C539V | + |
| 1402 | Y14F_D168V_E170L_C362V_Y441G_C539V_I551A | ++ |
| 1403 | Y14F_D168V_E170L_C362V_L440F_Y441G_C539V | + |
| 1404 | Y14F_V121A_D168A_E170A_C362L_L440F_Y441G | + |
| 1405 | Y14N_R122S_R150V_D168A_E170A_L440F_Y441G_R496T_R537S_E559K_N759P | ++ |
| 1406 | Y14F_D168A_E170A_A352Q_C362L_L440F_Y441G | + |
| 1407 | Y14F_D168A_E170A_D330N_L440F_Y441G | ++ |
| 1408 | Y14F_D168A_E170A_F326T_C362L_L440F_Y441G | + |
| 1409 | Y14F_D168A_E170A_G275K_L440F_Y441G | + |
| 1410 | Y14F_D168V_E170L_C362V_Y441G_I445L_C539V | + |
| 1411 | Y14F_D168V_E170L_C362V_Y441G_C539V_A547G | + |
| 1412 | Y14F_V85R_D168A_E170A_L440F_Y441G | + |
| 1413 | Y14N_R122S_E157F_D168A_E170A_L440F_Y441G_I480F_R496T_R537S_E559N | ++ |
| 1414 | Y14F_E76Q_D168A_E170A_L440F_Y441G | + |
| 1415 | Y14F_D168V_E170L_C362V_Y441G_Y524L_C539V | 0 |

FIG. 141-5

Table 4: Wild type NOZ 58130 = SEQ ID NO:1316

| SEQ# | Mutations based on SEQ ID NOS: 1316 | Incorp'n |
|---|---|---|
| 1416 | Y14F_D168V_E170L_C362V_Y441G_C539V_I551L | + |
| 1417 | Y14F_D168V_E170L_L440F_Y441G | ++ |
| 1418 | Y14F_D168V_E170L_C362V_Y441G_F511Y_C539V | + |
| 1419 | Y14F_D168A_E170A_C362L_L440F_Y441G_W791R_F792^ | + |
| 1420 | Y14F_D168A_E170A_G275N_L440F_Y441G | + |
| 1421 | Y14N_R122S_E157F_D168A_E170A_L440F_Y441G_R496T_R537S_E559N_N759P | ++ |
| 1422 | Y14F_D168A_E170A_D321F_C362L_L440F_Y441G | + |
| 1423 | Y14F_D168V_E170L_C362V_S439A_L440F_Y441G_C539V | + |
| 1424 | Y14N_R122S_E157F_D168A_E170A_L440F_Y441G_I480Y_R496T_R537S_E559N | ++ |
| 1425 | Y14F_D168A_E170A_F326T_L440F_Y441G | + |
| 1426 | Y14F_D168A_E170A_C362L_T327Q_L440F_Y441G | + |
| 1427 | Y14F_D168V_E170L_C362V_Y441G_F511V_C539V | + |
| 1428 | Y14F_E76N_D168A_E170A_C362L_L440F_Y441G | + |
| 1429 | Y14F_D168V_E170L_C362V_Y441G_Y524F_C539V | 0 |
| 1430 | Y14F_D168V_E170L_C362V_L440F_Y441G_S443A_C539V | + |
| 1431 | Y14D_R122S_D168A_E170A_L313M_L440F_Y441G_R496T_A515T_R537S_E559K | 0 |
| 1432 | Y14N_R122S_R150A_D168A_E170A_C362L_L440F_Y441G_R496T_R537S_E559N | ++ |
| 1433 | Y14F_W135S_D168A_E170A_C362L_L440F_Y441G | + |
| 1434 | Y14F_D168A_E170A_F326N_C362L_L440F_Y441G | + |

FIG. 141-6

Table 4: Wild type NOZ 58130 = SEQ ID NO:1316

| SEQ# | Mutations based on SEQ ID NOS: 1316 | Incorp'n |
|---|---|---|
| 1435 | Y14F_D168A_E170A_P292R_L440F_Y441G | + |
| 1436 | Y14F_D168A_E170A_K319R_L440F_Y441G | + |
| 1437 | Y14F_D168V_E170L_C362V_Y441G_I444V_C539V | + |
| 1438 | Y14F_P83R_D168A_E170A_L440F_Y441G | ++ |
| 1439 | Y14F_D168A_E170A_L290I_C362L_L440F_Y441G | + |
| 1440 | Y14F_D168A_E170A_C362L_L440F_Y441G_R790^ | + |
| 1441 | Y14N_R122S_R150A_D168A_E170A_V298I_L440F_Y441G_R496T_R537S_E559N | ++ |
| 1442 | Y14N_R122S_R150A_D168A_E170A_L440F_Y441G_R496T_R537S_E559N_N759P | ++ |
| 1443 | Y14F_V85R_D168A_E170A_C362L_L440F_Y441G | + |
| 1444 | Y14F_D168A_E170A_L440F_Y441G_M723^ | 0 |
| 1445 | Y14F_D168A_E170A_C362L_L440F_Y441G_G773^ | + |
| 1446 | Y14F_D168A_E170A_C362L_L440F_Y441G_M723T | + |
| 1447 | Y14N_R122S_R150A_D168A_E170A_E331N_L440F_Y441G_R496T_R537S_E559N | ++ |

FIG. 141-7

Table 5: Wild type NOZ 58130 = SEQ ID NO:1316

| SEQ# | Mutations based on SEQ ID NOS: 1316 | Intensity |
|---|---|---|
| 1448 | Y14F_D168A_E170A_L440F_Y441G_G782^ | ++ |
| 1449 | Y14F_D168A_E170A_L440F_Y441G_G782^ | ++ |
| 1450 | D168A_E170A_G782^ | ++ |

FIG. 142-1

Table 6: Wild type NOZ 58130 = SEQ ID NO:1316

| SEQ# | Mutations based on SEQ ID NO:1316 |
|---|---|
| 1451 | Y14F_D168A_E170A_E406R_L440F_Y441G |
| 1452 | Y14N_R122S_D168A_E170A_L440F_Y441G_R496T_E559N |
| 1453 | Y14D_R122S_D168A_E170A_L440F_Y441G_I480F_R496T_A515T_R537S_E559N |
| 1454 | Y14D_R122S_D168A_E170A_L440F_Y441G_A515T_E559N |
| 1455 | Y14I_D168A_E170A_L440F_Y441G_E559N |
| 1456 | Y14D_R150V_D168A_E170A_L440F_Y441G_R496T_R537S_E559N |
| 1457 | Y14N_R122S_R150V_D168A_E170A_L440F_Y441G_R496T_R537S_E559N |
| 1458 | Y14N_E157F_D168A_E170A_L440F_Y441G_R496T_E559K |
| 1459 | Y14F_R122S_D168A_E170A_L440F_Y441G_E559N |
| 1460 | Y14D_D168A_E170A_L440F_Y441G_I480F_R496T_A515T_R537S_E559N |
| 1461 | Y14F_E153R_D168A_E170A_L440F_Y441G |
| 1462 | Y14F_R150K_D168A_E170A_L440F_Y441G |
| 1463 | Y14N_R122S_D168A_E170A_L440F_Y441G_R496T_R537S_E559K_N759P |
| 1464 | Y14D_D168A_E170A_L440F_Y441G_I480Y_R537S_E559N |
| 1465 | Y14F_D168A_E170A_L440F_Y441G_A515V_S522N |
| 1466 | Y14D_R122S_D168A_E170A_E331N_L440F_Y441G_R496T_A515T_R537S_E559N |
| 1467 | Y14D_E157F_D168A_E170A_L440F_Y441G_R496T_A515T_R537S_E559N |
| 1468 | Y14F_D168A_E170A_L440S_Y441A_P442G_A515L |
| 1469 | Y14F_R150L_D168A_E170A_L440F_Y441G |

FIG. 143-1

Table 6: Wild type NOZ 58130 = SEQ ID NO:1316

| SEQ# | Mutations based on SEQ ID NO:1316 |
|---|---|
| 1470 | Y14N_R150V_D168A_E170A_L440F_Y441G_R496T_E559K |
| 1471 | Y14N_R122S_D168A_E170A_L440F_Y441G_R496T_R537S_E559K |
| 1472 | Y14F_R122D_D168A_E170A_L440F_Y441G_A515T |
| 1473 | Y14D_E153K_D168A_E170A_L440F_Y441G_R496T_E559K |
| 1474 | Y14N_R122S_D168A_E170A_C362L_L440F_Y441G_R496T_A515T_R537S_E559N |
| 1475 | Y14N_D168A_E170A_L313M_L440F_Y441G_E559K |
| 1476 | Y14D_R122S_E156N_D168A_E170A_L440F_Y441G_R496T_R537S_E559N |
| 1477 | Y14D_R122S_D168A_E170A_E331N_L440F_Y441G_R496T_R537S_E559N |
| 1478 | Y14D_D168A_E170A_L440F_Y441G_I480Y_E559K |
| 1479 | Y14F_D168A_E170A_L440S_Y441A_P442G_A515S |
| 1480 | Y14F_D168A_E170A_A515L |
| 1481 | Y14D_R122S_D168A_E170A_L440F_Y441G_R496T_E559N |
| 1482 | Y14D_R122S_R150V_D168A_E170A_L440F_Y441G_R496T_E559N |
| 1483 | Y14F_D168A_E170A_L440F_Y441G_A515T_F523V |
| 1484 | Y14N_D168A_E170A_L440F_Y441G_R496T_R537S_E559N_N759P |
| 1485 | Y14F_D168A_E170A_L440F_Y441G_A515T_R537G |
| 1486 | Y14N_D168A_E170A_C362L_L440F_Y441G_R496T_R537S_E559K |
| 1487 | Y14D_D168A_E170A_E331N_L440F_Y441G_R496T_A515T_R537S_E559N |

FIG. 143-2

Table 6: Wild type NOZ 58130 = SEQ ID NO:1316

| SEQ# | Mutations based on SEQ ID NO:1316 |
|---|---|
| 1488 | Y14N_R122S_D168A_E170A_L440F_Y441G_R496T_R537S_E559N_N759P |
| 1489 | Y14D_R122S_D168V_E170V_L440F_Y441G_R496T_A515T_R537S_E559N |
| 1490 | Y14N_R122S_D168A_E170A_L440F_Y441G_I480F_R496T_A515T_R537S_E559N |
| 1491 | Y14D_R122S_R150V_D168A_E170A_L440F_Y441G_R496T_R537S_E559K |
| 1492 | Y14N_R122S_D168V_E170V_L440F_Y441G_R496T_E559K |
| 1493 | Y14F_D168A_E170A_L440A_Y441A_P442A |
| 1494 | Y14N_D168A_E170A_L440F_Y441G_I480Y_E559K |
| 1495 | Y14N_D168A_E170A_L440F_Y441G_R496T_A515T_R537S_E559N |
| 1496 | Y14D_R150V_D168A_E170A_L440F_Y441G_R496T_R537S_E559K |
| 1497 | Y14N_D168V_E170V_L440F_Y441G_E559K |
| 1498 | Y14D_R122S_D168A_E170A_L440F_Y441G_E559N |
| 1499 | Y14F_D168A_E170A_L440F_Y441G_S698R |
| 1500 | Y14D_R122S_D168A_E170A_L313M_L440F_Y441G_R496T_A515T_R537S_E559N |
| 1501 | Y14N_D168A_E170A_L440F_Y441G_E559N |
| 1502 | Y14F_D168A_E170A_L440F_Y441G_A515S |
| 1503 | Y14N_R150A_D168A_E170A_L440F_Y441G_R496T_E559K |
| 1504 | Y14N_R122S_R150A_D168A_E170A_L440F_Y441G_R496T_A515T_R537S_E559K |
| 1505 | Y14F_D168A_E170A_L440F_Y441G_I480Y |
| 1506 | Y14N_D168A_E170A_L440F_Y441G_I480F_E559K |

FIG. 143-3

Table 6: Wild type NOZ 58130 = SEQ ID NO:1316

| SEQ# | Mutations based on SEQ ID NO:1316 |
|---|---|
| 1507 | Y14N_D168A_E170A_V298I_L440F_Y441G_R496T_A515T_R537S_E559N |
| 1508 | Y14F_D168A_E170A_L440F_Y441G |
| 1509 | Y14N_D168A_E170A_L440F_Y441G_R496T_E559N_N759P |
| 1510 | Y14F_D168A_E170A_L440F_Y441G_F523S |
| 1511 | Y14D_E157F_D168A_E170A_L440F_Y441G_R496T_E559N |
| 1512 | Y14N_D168A_E170A_L440F_Y441G_E559K |
| 1513 | Y14F_D168A_E170A_L440F_Y441G_A515V_F523I |
| 1514 | Y14D_R122S_D168A_E170A_L440F_Y441G_A515T_R537S_E559K |
| 1515 | Y14F_V97A_D168A_E170A_L440F_Y441G |
| 1516 | Y14N_R122S_D168A_E170A_L440F_Y441G_I480F_R496T_E559K |
| 1517 | Y14D_D168A_E170A_L440F_Y441G_I480F_E559K |
| 1518 | Y14N_R122S_R150V_D168A_E170A_L440F_Y441G_R496T_E559N |
| 1519 | Y14N_R150A_D168A_E170A_L440F_Y441G_R496T_E559N |
| 1520 | Y14N_R122S_D168A_E170A_L440F_Y441G_E559N |
| 1521 | Y14D_R122S_D168A_E170A_V298I_L440F_Y441G_R496T_A515T_R537S_E559N |
| 1522 | Y14N_D168A_E170A_L440F_Y441G_R496T_R537S_E559N |
| 1523 | D168A_E170A_L440S_Y441A_P442G |
| 1524 | Y14N_R122S_D168A_E170A_E331N_L440F_Y441G_R496T_E559N |

FIG. 143-4

Table 6: Wild type NOZ 58130 = SEQ ID NO:1316

| SEQ# | Mutations based on SEQ ID NO:1316 |
|---|---|
| 1525 | Y14D_R122S_D168A_E170A_C362L_L440F_Y441G_R496T_E559K |
| 1526 | Y14F_D168F_E170A_L440F_Y441G |
| 1527 | Y14F_E153F_D168A_E170A_L440F_Y441G |
| 1528 | D168A_E170A_L440S_Y441A |
| 1529 | Y14F_D168A_E170A_C362V_L440F_Y441G |
| 1530 | Y14N_R122S_D168A_E170A_L440F_Y441G_R496T_A515T_R537S_E559N_N759P |
| 1531 | Y14D_E156N_D168A_E170A_L440F_Y441G_E559K |
| 1532 | Y14D_E157F_D168A_E170A_L440F_Y441G_R496T_R537S_E559N |
| 1533 | Y14D_R122S_D168A_E170A_L440F_Y441G_A515T_E559K |
| 1534 | Y14N_R122S_E157F_D168A_E170A_L440F_Y441G_R496T_A515T_R537S_E559K |
| 1535 | Y14D_D168V_E170V_L440F_Y441G_E559K |
| 1536 | Y14D_R122S_R150V_D168A_E170A_L440F_Y441G_R496T_A515T_R537S_E559K |
| 1537 | Y14D_D168A_E170A_V298I_L440F_Y441G_E559K |
| 1538 | Y14F_D168A_E170A_E331N_L440F_Y441G |
| 1539 | Y14D_R122S_R150A_D168A_E170A_L440F_Y441G_R496T_R537S_E559K |
| 1540 | Y14D_D168A_E170A_L313M_L440F_Y441G_E559K |
| 1541 | D168A_E170A |
| 1542 | Y14F_D168A_E170A_L440F_Y441G_A515T |
| 1543 | Y14N_D168A_E170A_V298I_L440F_Y441G_R496T_E559K |
| 1544 | Y14F_D168A_E170A_L440S_Y441A_P442G_A515T |

FIG. 143-5

Table 6: Wild type NOZ 58130 = SEQ ID NO:1316

| SEQ# | Mutations based on SEQ ID NO:1316 |
|---|---|
| 1545 | Y14N_R122S_D168A_E170A_L440F_Y441G_A515T_R537S_E559K |
| 1546 | Y14N_D168A_E170A_L313M_L440F_Y441G_R496T_R537S_E559N |
| 1547 | Y14N_D168A_E170A_E331N_L440F_Y441G_R496T_R537S_E559N |
| 1548 | Y14F_R122S_D168A_E170A_L440F_Y441G_R496T_E559K |
| 1549 | Y14F_D168A_E170A_L440Y_Y441A_A515L |
| 1550 | Y14N_R122S_D168A_E170A_V298I_L440F_Y441G_R496T_E559K |
| 1551 | Y14D_R122S_D168A_E170A_L440F_Y441G_I480F_R496T_E559N |
| 1552 | Y14F_E157R_D168A_E170A_L440F_Y441G |
| 1553 | Y14N_R122S_E157F_D168A_E170A_L440F_Y441G_R496T_R537S_E559N |
| 1554 | Y14D_D168A_E170A_V298I_L440F_Y441G_R496T_R537S_E559K |
| 1555 | Y14D_D168V_E170V_L440F_Y441G_R496T_E559K |
| 1556 | Y14F_D168A_E170A_L440F_Y441T_P442A_E559N |
| 1557 | Y14F_D168A_E170A_L440F_Y441G_P442A_A515V |
| 1558 | Y14D_R122S_D168A_E170A_L440F_Y441G_R496T_E559N_N759P |
| 1559 | Y14D_D168A_E170A_L440F_Y441G_I480Y_R496T_R537S_E559K |
| 1560 | Y14F_D168A_E170A_L440Y_Y441G_A515S |
| 1561 | Y14D_R150A_D168A_E170A_L440F_Y441G_R496T_A515T_R537S_E559N |
| 1562 | Y14D_R122S_D168A_E170A_E331N_L440F_Y441G_R496T_E559K |

FIG. 143-6

Table 6: Wild type NOZ 58130 = SEQ ID NO:1316

| SEQ# | Mutations based on SEQ ID NO:1316 |
|---|---|
| 1563 | Y14D_R122S_R150V_D168A_E170A_L440F_Y441G_R496T_E559K |
| 1564 | Y14F_D168A_E170F_L440F_Y441G |
| 1565 | Y14N_R122S_D168A_E170A_L313M_L440F_Y441G_R496T_E559N |
| 1566 | Y14F_D168A_E170A_A515V |
| 1567 | Y14D_R122S_D168A_E170A_V298I_L440F_Y441G_R496T_R537S_E559N |
| 1568 | Y14N_D168A_E170A_L440F_Y441G_R496T_R537S_E559K |
| 1569 | Y14N_R122S_D168A_E170A_L440F_Y441G_I480F_R496T_R537S_E559K |
| 1570 | Y14D_D168A_E170A_L313M_L440F_Y441G_R537S_E559N |
| 1571 | Y14F_D168A_E170A_L440F_Y441A_P442G_A515S |
| 1572 | Y14D_R122S_D168A_E170A_L440F_Y441G_I480F_R496T_R537S_E559K |
| 1573 | Y14D_D168A_E170A_L440F_Y441G_R537S_E559N_N759P |
| 1574 | Y14F_D168A_E170A_L440F_Y441G_A515T_F523T |
| 1575 | Y14F_D168A_E170A_L440Y_Y441A_A515V |
| 1576 | Y14N_R150A_D168A_E170A_L440F_Y441G_R496T_R537S_E559N |
| 1577 | Y14F_D168V_E170A_L440F_Y441G |
| 1578 | Y14N_R122S_D168A_E170A_L313M_L440F_Y441G_R496T_A515T_R537S_E559N |
| 1579 | Y14F_D168A_E170A_L440F_Y441G_S522T |
| 1580 | Y14F_D168A_E170A_V384Y_L440F_Y441G |

FIG. 143-7

Table 6: Wild type NOZ 58130 = SEQ ID NO:1316

| SEQ# | Mutations based on SEQ ID NO:1316 |
|---|---|
| 1581 | Y14D_D168A_E170A_L440F_Y441G_I480F_R496T_E559N |
| 1582 | Y14N_R122S_D168A_E170A_L440F_Y441G_R496T_E559K_N759P |
| 1583 | Y14F_D168A_E170V_L440F_Y441G |
| 1584 | Y14N_D168A_E170A_L440F_Y441G_I480F_R496T_E559N |
| 1585 | Y14D_D168A_E170A_L440F_Y441G_R496T_E559K_N759P |
| 1586 | Y14F_D168A_E170A |
| 1587 | Y14D_E156N_D168A_E170A_L440F_Y441G_R496T_A515T_R537S_E559N |
| 1588 | Y14D_D168A_E170A_E331N_L440F_Y441G_R496T_E559N |
| 1589 | Y14F_R122N_D168A_E170A_L440F_Y441G_A515T |
| 1590 | Y14N_R122S_R150A_D168A_E170A_L440F_Y441G_R496T_E559K |
| 1591 | Y14F_D168A_E170I_L440F_Y441G |
| 1592 | Y14N_R122S_E157F_D168A_E170A_L440F_Y441G_R496T_E559N |
| 1593 | Y14D_D168A_E170A_L440F_Y441G_R496T_E559N |
| 1594 | Y14D_D168A_E170A_L440F_Y441G_I480F_R496T_R537S_E559K |
| 1595 | Y14N_R122S_R150V_D168A_E170A_L440F_Y441G_R496T_E559K |
| 1596 | Y14N_R122S_R150V_D168A_E170A_L440F_Y441G_R496T_E559K |
| 1597 | Y14N_E153K_D168A_E170A_L440F_Y441G_R496T_E559K |
| 1598 | Y14N_R122S_D168A_E170A_E331N_L440F_Y441G_R496T_R537S_E559N |

FIG. 143-8

Table 6: Wild type NOZ 58130 = SEQ ID NO:1316

| SEQ# | Mutations based on SEQ ID NO:1316 |
|---|---|
| 1599 | Y14F_D168A_E170A_L440F_Y441G_A515V |
| 1600 | Y14F_D168A_E170A_L440S_Y441A_A515V |
| 1601 | Y14F_D168I_E170A_L440F_Y441G |
| 1602 | Y14F_D168A_E170A_L440Y_Y441A_P442G_A515S |
| 1603 | Y14D_R150A_D168A_E170A_L440F_Y441G_R496T_R537S_E559K |
| 1604 | Y14D_R122S_D168A_E170A_L313M_L440F_Y441G_R496T_R537S_E559K |
| 1605 | Y14F_E157A_D168A_E170A_L440F_Y441G |
| 1606 | Y14D_D168A_E170A_E331N_L440F_Y441G_R537S_E559N |
| 1607 | Y14F_D168A_E170A_L440Y_Y441G_P442A |
| 1608 | Y14F_D168A_E170A_L440Y_Y441A_P442G_A515V |
| 1609 | Y14D_R122S_D168A_E170A_L440F_Y441G_E559K |
| 1610 | Y14N_R122S_D168A_E170A_L440F_Y441G_I480F_R496T_E559N |
| 1611 | Y14N_D168A_E170A_L440F_Y441G_A515T |
| 1612 | Y14D_R150A_D168A_E170A_L440F_Y441G_R496T_E559N |
| 1613 | Y14N_R150V_D168A_E170A_L440F_Y441G_R496T_R537S_E559N |
| 1614 | Y14D_R122S_D168A_E170A_V298I_L440F_Y441G_R496T_E559N |
| 1615 | Y14N_E156N_D168A_E170A_L440F_Y441G_R496T_E559N |
| 1616 | Y14F_R150F_D168A_E170A_L440F_Y441G |
| 1617 | Y14D_R150A_D168A_E170A_L440F_Y441G_R496T_R537S_E559N |
| 1618 | Y14N_D168V_E170V_L440F_Y441G_R496T_A515T_R537S_E559N |

FIG. 143-9

Table 6: Wild type NOZ 58130 = SEQ ID NO:1316

| SEQ# | Mutations based on SEQ ID NO:1316 |
|---|---|
| 1619 | Y14F_D168A_E170A_L440F_Y441G_A515V_F523S |
| 1620 | Y14F_E153V_D168A_E170A_L440F_Y441G |
| 1621 | Y14D_E156N_D168A_E170A_L440F_Y441G_R496T_R537S_E559K |
| 1622 | Y14N_R150V_D168A_E170A_L440F_Y441G_R496T_R537S_E559N |
| 1623 | Y14F_D168A_E170A_L440S_Y441A_P442G |
| 1624 | Y14N_R150A_D168A_E170A_L440F_Y441G_R496T_R537S_E559N |
| 1625 | Y14D_D168A_E170A_L440F_Y441G_E559N |
| 1626 | D168A_E170A_L440S_Y441A_P442G |
| 1627 | Y14N_R122S_D168A_E170A_E331N_L440F_Y441G_R496T_E559K |
| 1628 | Y14N_D168A_E170A_L440F_Y441G_I480F_R496T_A515T_R537S_E559N |
| 1629 | Y14N_E157F_D168A_E170A_L440F_Y441G_R496T_R537S_E559K |
| 1630 | Y14N_D168A_E170A_L440F_Y441G_R496T_E559K |
| 1631 | Y14N_R122S_R150A_D168A_E170A_L440F_Y441G_R496T_E559N |
| 1632 | Y14D_D168A_E170A_L440F_Y441G_A515T |
| 1633 | Y14D_R122S_E156N_D168A_E170A_L440F_Y441G_R496T_E559K |
| 1634 | Y14F_D168A_E170A_L440F_Y441A_P442G |
| 1635 | Y14F_R122S_D168A_E170A_L440F_Y441G_R496T_A515T_R537S_E559N |
| 1636 | Y14D_E156N_D168A_E170A_L440F_Y441G_R537S_E559N |
| 1637 | Y14F_D168A_E170A_L440F_Y441G_Q691Y |
| 1638 | Y14F_D168A_E170A_L440Y_Y441G_A515L |

FIG. 143-10

Table 6: Wild type NOZ 58130 = SEQ ID NO:1316

| SEQ# | Mutations based on SEQ ID NO:1316 |
|---|---|
| 1639 | Y14D_R122S_D168V_E170V_L440F_Y441G_R496T_E559K |
| 1640 | Y14D_R122S_D168A_E170A_L440F_Y441G_I480Y_R496T_A515T_R537S_E559N |
| 1641 | Y14F_D168A_E170A_L440S_Y441A_A515L |
| 1642 | Y14N_R122S_D168V_E170V_L440F_Y441G_R496T_A515T_R537S_E559N |
| 1643 | Y14F_D168A_E170L_L440F_Y441G |
| 1644 | Y14N_R122S_D168A_E170A_L440F_Y441G_I480Y_R496T_R537S_E559K |
| 1645 | Y14D_D168A_E170A_L440F_Y441G_R537S_E559K |
| 1646 | Y14D_D168A_E170A_L440F_Y441G_E559K_N759P |
| 1647 | Y14N_R122S_E157F_D168A_E170A_L440F_Y441G_R496T_R537S_E559N |
| 1648 | Y14D_R150A_D168A_E170A_L440F_Y441G_R496T_A515T_R537S_E559K |
| 1649 | Y14D_D168A_E170A_L313M_L440F_Y441G_R496T_R537S_E559N |
| 1650 | Y14F_D168A_E170A_H297S_V298F_L440F_Y441G |
| 1651 | Y14F_D168A_E170A_L440F_Y441G_E559N |
| 1652 | Y14N_R122S_E153K_D168A_E170A_L440F_Y441G_R496T_R537S_E559N |
| 1653 | Y14N_D168A_E170A_L440F_Y441G_I480Y_R496T_A515T_R537S_E559N |
| 1654 | Y14F_D168A_E170A_L440F_Y441G_R537K |
| 1655 | Y14D_R150A_D168A_E170A_L440F_Y441G_R496T_E559N |
| 1656 | Y14N_E157F_D168A_E170A_L440F_Y441G_R496T_E559N |
| 1657 | Y14D_D168A_E170A_L440F_Y441G_R496T_R537S_E559N |

FIG. 143-11

Table 6: Wild type NOZ 58130 = SEQ ID NO:1316

| SEQ# | Mutations based on SEQ ID NO:1316 |
|---|---|
| 1658 | Y14F_D168A_E170A_L440Y_Y441G |
| 1659 | Y14D_D168A_E170A_E331N_L440F_Y441G_E559K |
| 1660 | Y14N_R122S_D168A_E170A_L440F_Y441G_R496T_A515T_E559K |
| 1661 | Y14N_D168A_E170A_L440F_Y441G_I480Y_R496T_E559K |
| 1662 | Y14D_R122S_D168A_E170A_L440F_Y441G_R496T_R537S_E559N |
| 1663 | Y14D_R150V_D168A_E170A_L440F_Y441G_R496T_A515T_R537S_E559K |
| 1664 | Y14D_D168A_E170A_V298I_L440F_Y441G_R496T_A515T_R537S_E559N |
| 1665 | Y14N_R122S_D168A_E170A_L440F_Y441G_E559K |
| 1666 | Y14N_D168A_E170A_L440F_Y441G_R496T_A515T_R537S_E559K |
| 1667 | Y14F_D168A_E170A_L440F_Y441G_Q691T |
| 1668 | Y14N_R150V_D168A_E170A_L440F_Y441G_R496T_E559N |
| 1669 | Y14N_D168A_E170A_V298I_L440F_Y441G_R496T_R537S_E559K |
| 1670 | Y14N_D168A_E170A_E331N_L440F_Y441G_R496T_R537S_E559K |
| 1671 | Y14D_D168A_E170A_L313M_L440F_Y441G_R496T_E559K |
| 1672 | Y14D_R122S_R150A_D168A_E170A_L440F_Y441G_R496T_E559N |
| 1673 | Y14D_D168A_E170A_L440F_Y441G_E559K |
| 1674 | Y14F_D168A_E170A_E331R_L440F_Y441G |
| 1675 | Y14D_D168A_E170A_L440F_Y441G_I480Y_R496T_R537S_E559N |
| 1676 | Y14N_D168A_E170A_E331N_L440F_Y441G_R496T_E559N |

FIG. 143-12

Table 6: Wild type NOZ 58130 = SEQ ID NO:1316

| SEQ# | Mutations based on SEQ ID NO:1316 |
|---|---|
| 1677 | Y14D_R122S_D168A_E170A_E331N_L440F_Y441G_R496T_R537S_E559K |
| 1678 | Y14F_D168A_E170A_V298I_L440F_Y441G |
| 1679 | Y14D_R122S_D168A_E170A_L440F_Y441G_R537S_E559N |
| 1680 | Y14D_D168A_E170A_V298I_L440F_Y441G_R496T_E559K |
| 1681 | Y14F_D168A_E170A_L440F_Y441G_R496T_A515T |
| 1682 | Y14D_R122S_D168A_E170A_L440F_Y441G_I480Y_R496T_R537S_E559K |
| 1683 | Y14F_D168A_E170A_L440F_Y441G_D671N |
| 1684 | Y14D_D168A_E170A_L440F_Y441G_R496T_R537S_E559K |
| 1685 | Y14F_E157V_D168A_E170A_L440F_Y441G |
| 1686 | Y14N_E156N_D168A_E170A_L440F_Y441G_R537S_E559N |
| 1687 | Y14D_R122S_D168A_E170A_L440F_Y441G_R496T_A515T_R537S_E559N |
| 1688 | Y14N_R122S_D168A_E170A_L440F_Y441G_A515T_E559K |
| 1689 | Y14N_R122S_D168A_E170A_L440F_Y441G_R537S_E559K |
| 1690 | Y14N_R122S_E156N_D168A_E170A_L440F_Y441G_R496T_E559K |
| 1691 | Y14N_R122S_E157F_D168A_E170A_L440F_Y441G_R496T_R537S_E559K |
| 1692 | Y14N_R122S_R150V_D168A_E170A_L440F_Y441G_R496T_R537S_E559K |
| 1693 | Y14N_R150V_D168A_E170A_L440F_Y441G_R496T_E559N |
| 1694 | Y14D_R122S_D168A_E170A_L440F_Y441G_R496T_R537S_E559K_N759P |
| 1695 | D168A_E170A_L440F_Y441G |

FIG. 143-13

Table 6: Wild type NOZ 58130 = SEQ ID NO:1316

| SEQ# | Mutations based on SEQ ID NO:1316 |
|---|---|
| 1696 | Y14N_D168A_E170A_C362L_L440F_Y441G_E559K |
| 1697 | Y14N_D168A_E170A_C362L_L440F_Y441G_R537S_E559N |
| 1698 | Y14F_D168A_E170A_L440F_Y441G_R537S_E559N |
| 1699 | Y14D_R122S_E156N_D168A_E170A_L440F_Y441G_R496T_R537S_E559K |
| 1700 | Y14F_D168A_E170A_L440A_Y441A_P442A_A515V |
| 1701 | Y14N_D168A_E170A_C362L_L440F_Y441G_R496T_R537S_E559N |
| 1702 | Y14F_D168A_E170A_L440F_Y441G_I480F |
| 1703 | Y14F_D168A_E170A_L440S_Y441A_A515T |
| 1704 | Y14F_D168A_E170A_L440F_Y441G_C539L |
| 1705 | Y14D_R122S_E153K_D168A_E170A_L440F_Y441G_R496T_E559N |
| 1706 | Y14F_D168A_E170A_L440F_Y441G_A515L |
| 1707 | Y14N_R122S_D168A_E170A_L313M_L440F_Y441G_R496T_R537S_E559N |
| 1708 | Y14D_R122S_D168A_E170A_C362L_L440F_Y441G_R496T_A515T_R537S_E559N |
| 1709 | Y14D_R122S_E153K_D168A_E170A_L440F_Y441G_R496T_A515T_R537S_E559N |
| 1710 | Y14N_D168A_E170A_V298I_L440F_Y441G_E559K |
| 1711 | Y14F_D168A_E170A_L440F_Y441G_A515T |
| 1712 | Y14F_D168A_E170A_L440F_Y441G_N759P |
| 1713 | Y14F_D168A_E170A_L440S_Y441A_P442G_A515V |
| 1714 | Y14F_D168A_E170A_L440F_Y441G_R496T |

FIG. 143-14

Table 6: Wild type NOZ 58130 = SEQ ID NO:1316

| SEQ# | Mutations based on SEQ ID NO:1316 |
|---|---|
| 1715 | Y14F_D168A_E170A_L440F_Y441A_P442G_A515T |
| 1716 | Y14F_D168A_E170A_L313M_L440F_Y441G |
| 1717 | Y14N_R122S_E157F_D168A_E170A_L440F_Y441G_R496T_E559N |
| 1718 | Y14N_D168A_E170A_L440F_Y441G_I480F_R496T_R537S_E559N |
| 1719 | Y14N_R122S_D168V_E170V_L440F_Y441G_R496T_R537S_E559K |
| 1720 | Y14N_D168A_E170A_L313M_L440F_Y441G_R496T_A515T_R537S_E559N |
| 1721 | Y14D_D168A_E170A_C362L_L440F_Y441G_R496T_R537S_E559K |
| 1722 | Y14D_D168V_E170V_L440F_Y441G_R496T_A515T_R537S_E559N |
| 1723 | Y14D_E153K_D168A_E170A_L440F_Y441G_R496T_R537S_E559K |
| 1724 | D168A_E170A_A515L |
| 1725 | Y14N_R150V_D168A_E170A_L440F_Y441G_R496T_R537S_E559K |
| 1726 | Y14F_D168A_E170A_A515T |
| 1727 | Y14N_D168A_E170A_L440F_Y441G_I480F_R496T_E559K |
| 1728 | Y14F_D168A_E170A_L440F_Y441G_A515V_E559N |
| 1729 | Y14N_D168A_E170A_L440F_Y441G_I480Y_R496T_E559N |
| 1730 | Y14N_D168A_E170A_E331N_L440F_Y441G_R496T_A515T_R537S_E559N |
| 1731 | Y14N_E156N_D168A_E170A_L440F_Y441G_E559K |
| 1732 | Y14D_D168A_E170A_C362L_L440F_Y441G_R537S_E559N |
| 1733 | Y14D_D168A_E170A_L440F_Y441G_R496T_A515T_R537S_E559N_N759P |

FIG. 143-15

Table 6: Wild type NOZ 58130 = SEQ ID NO:1316

| SEQ# | Mutations based on SEQ ID NO:1316 |
|---|---|
| 1734 | Y14F_D168A_E170A_L440F_Y441G_S443R_E559K |
| 1735 | Y14F_D168A_E170A_L440Y_Y441G_A515V |
| 1736 | Y14D_D168A_E170A_C362L_L440F_Y441G_R496T_R537S_E559N |
| 1737 | Y14N_D168A_E170A_L440F_Y441G_R496T_R537S_E559K_N759P |
| 1738 | Y14N_D168A_E170A_E331N_L440F_Y441G_R496T_E559K |
| 1739 | Y14N_R122S_E153K_D168A_E170A_L440F_Y441G_R496T_A515T_R537S_E559K |
| 1740 | Y14D_D168A_E170A_V298I_L440F_Y441G_R496T_R537S_E559N |
| 1741 | Y14D_R122S_E156N_D168A_E170A_L440F_Y441G_R496T_E559N |
| 1742 | Y14F_D168A_E170A_L440F_Y441G_C539V |
| 1743 | Y14N_R122S_D168A_E170A_E331N_L440F_Y441G_R496T_R537S_E559K |
| 1744 | Y14D_R122S_D168A_E170A_C362L_L440F_Y441G_R496T_E559N |
| 1745 | Y14N_R122S_D168A_E170A_V298I_L440F_Y441G_R496T_R537S_E559N |
| 1746 | Y14F_D168A_E170A_L440Y_Y441A_P442G_A515L |
| 1747 | Y14N_E157F_D168A_E170A_L440F_Y441G_R496T_R537S_E559K |
| 1748 | Y14N_R122S_D168A_E170A_L440F_Y441G_I480Y_R496T_R537S_E559N |
| 1749 | Y14D_R122S_D168A_E170A_L313M_L440F_Y441G_R496T_R537S_E559N |
| 1750 | Y14N_R122S_D168A_E170A_L440F_Y441G_R496T_A515T_E559N |
| 1751 | Y14N_D168A_E170A_L440F_Y441G_R496T_E559K_N759P |

FIG. 143-16

Table 6: Wild type NOZ 58130 = SEQ ID NO:1316

| SEQ# | Mutations based on SEQ ID NO:1316 |
|---|---|
| 1752 | D168A_E170A_L440S_Y441A_P442G_A515L |
| 1753 | Y14D_D168A_E170A_L440F_Y441G_I480Y_R496T_A515T_R537S_E559N |
| 1754 | Y14F_D168A_E170A_L440F_Y441G_A515T_S522K |
| 1755 | Y14F_D168A_E170A_L440F_Y441A_P442G_A515L |
| 1756 | Y14D_D168A_E170A_L440F_Y441G_A515V |
| 1757 | Y14F_R150A_D168A_E170A_L440F_Y441G |
| 1758 | Y14D_R122S_R150A_D168A_E170A_L440F_Y441G_R496T_A515T_R537S_E559K |
| 1759 | D168A_E170A_L440Y_Y441G |
| 1760 | Y14N_R122S_E156N_D168A_E170A_L440F_Y441G_R496T_R537S_E559N |
| 1761 | Y14N_R150V_D168A_E170A_L440F_Y441G_R496T_E559K |
| 1762 | Y14F_D168A_E170A_L440A_Y441A_P442A_A515T |
| 1763 | Y14D_D168A_E170A_L313M_L440F_Y441G_R496T_E559N |
| 1764 | Y14F_R122S_D168A_E170A_L440F_Y441G_R496T_R537S_E559K |
| 1765 | Y14N_E153K_D168A_E170A_L440F_Y441G_R496T_R537S_E559K |
| 1766 | Y14N_D168A_E170A_L313M_L440F_Y441G_R496T_R537S_E559K |
| 1767 | Y14F_D168A_E170A_L440F_Y441G_T693A |
| 1768 | Y14F_D168A_E170A_L440F_Y441G_C539A |
| 1769 | Y14F_D168A_E170A_L440F_Y441G_R496T_R537S_E559K |
| 1770 | Y14D_R150V_D168A_E170A_L440F_Y441G_R496T_E559N |
| 1771 | Y14F_D168A_E170A_L440F_Y441G_S698K |

FIG. 143-17

Table 6: Wild type NOZ 58130 = SEQ ID NO:1316

| SEQ# | Mutations based on SEQ ID NO:1316 |
|---|---|
| 1772 | Y14D_R122S_R150A_D168A_E170A_L440F_Y441G_R496T_R537S_E559K |
| 1773 | Y14F_R122S_D168A_E170A_L440F_Y441G_A515V |
| 1774 | Y14N_R122S_E157F_D168A_E170A_L440F_Y441G_R496T_E559K |
| 1775 | Y14F_D168A_E170A_L440F_Y441G_F523A_E559N |
| 1776 | Y14N_R122S_R150V_D168A_E170A_L440F_Y441G_R496T_E559N |
| 1777 | Y14F_D168A_E170A_L440F_Y441G_N759K |
| 1778 | Y14F_R150V_D168A_E170A_L440F_Y441G |
| 1779 | Y14F_D168A_E170A_L440F_Y441G_K628E |
| 1780 | Y14F_D168A_E170A_L440F_Y441G_F523V |
| 1781 | Y14N_D168V_E170V_L440F_Y441G_R496T_R537S_E559K |
| 1782 | Y14N_R122S_E153K_D168A_E170A_L440F_Y441G_R496T_E559N |
| 1783 | Y14N_D168A_E170A_L440F_Y441G_R537S_E559N |
| 1784 | Y14D_E157F_D168A_E170A_L440F_Y441G_R496T_E559K |
| 1785 | Y14N_D168V_E170V_L440F_Y441G_R496T_E559K |
| 1786 | Y14D_D168A_E170A_L440F_Y441G_R496T_R537S_E559N_N759P |
| 1787 | Y14N_E153K_D168A_E170A_L440F_Y441G_R496T_E559N |
| 1788 | Y14N_R122S_D168A_E170A_L313M_L440F_Y441G_R496T_E559K |
| 1789 | Y14D_E157F_D168A_E170A_L440F_Y441G_R496T_A515T_R537S_E559K |
| 1790 | Y14F_D168A_E170A_L440Y_Y441A_P442A_A515T |

FIG. 143-18

Table 6: Wild type NOZ 58130 = SEQ ID NO:1316

| SEQ# | Mutations based on SEQ ID NO:1316 |
|---|---|
| 1791 | Y14F_D168A_E170A_L440F_Y441G |
| 1792 | Y14D_R150A_D168A_E170A_L440F_Y441G_R496T_E559K |
| 1793 | Y14D_R122S_D168A_E170A_L440F_Y441G_R496T_R537S_E559K |
| 1794 | Y14D_R122S_D168V_E170V_L440F_Y441G_R496T_R537S_E559N |
| 1795 | Y14D_R122S_D168A_E170A_C362L_L440F_Y441G_R496T_R537S_E559K |
| 1796 | Y14F_D168A_E170A_L440S_Y441A_A515S |
| 1797 | Y14F_D168A_E170A_L440F_Y441G_F523A |
| 1798 | Y14F_D168A_E170A_L440F_Y441G_A515G |
| 1799 | Y14D_R122S_D168A_E170A_L440F_Y441G_I480F_R496T_R537S_E559N |
| 1800 | Y14N_R122S_D168A_E170A_L313M_L440F_Y441G_R496T_R537S_E559K |
| 1801 | Y14N_E156N_D168A_E170A_L440F_Y441G_R496T_R537S_E559N |
| 1802 | Y14D_R122S_D168A_E170A_L440F_Y441G_R496T_A515T_R537S_E559K |
| 1803 | Y14F_D168A_E170A_L440F_Y441G_R496G_E559K |
| 1804 | Y14F_D168A_E170A_L440F_Y441G_A515R |
| 1805 | Y14F_D168A_E170A_A276R_L440F_Y441G |
| 1806 | Y14N_D168A_E170A_C362L_L440F_Y441G_R496T_A515T_R537S_E559N |
| 1807 | Y14D_R150V_D168A_E170A_L440F_Y441G_R496T_R537S_E559N |
| 1808 | Y14F_R122G_G129C_D168A_E170A_L440F_Y441G_A515V |
| 1809 | Y14N_D168A_E170A_L440F_Y441G_E559K_N759P |
| 1810 | Y14N_R122S_D168A_E170A_L440F_Y441G_R496T_A515T_R537S_E559N |

FIG. 143-19

Table 6: Wild type NOZ 58130 = SEQ ID NO:1316

| SEQ# | Mutations based on SEQ ID NO:1316 |
|---|---|
| 1811 | Y14N_D168A_E170A_L440F_Y441G_I480F_R537S_E559N |
| 1812 | Y14N_R122S_D168A_E170A_C362L_L440F_Y441G_R496T_E559N |
| 1813 | Y14N_R122S_E156N_D168A_E170A_L440F_Y441G_R496T_R537S_E559K |
| 1814 | Y14F_E153L_D168A_E170A_L440F_Y441G |
| 1815 | Y14F_D168A_E170A_L440F_Y441G_R496A_A515V |
| 1816 | Y14N_R122S_D168A_E170A_C362L_L440F_Y441G_R496T_E559K |
| 1817 | Y14N_R122S_R150V_D168A_E170A_L440F_Y441G_R496T_R537S_E559N |
| 1818 | Y14D_R122S_D168A_E170A_L440F_Y441G_I480Y_R496T_R537S_E559N |
| 1819 | Y14F_E153A_D168A_E170A_L440F_Y441G |
| 1820 | Y14D_R122S_E157F_D168A_E170A_L440F_Y441G_R496T_A515T_R537S_E559K |
| 1821 | Y14N_E156N_D168A_E170A_L440F_Y441G_R496T_A515T_R537S_E559N |
| 1822 | Y14D_R122S_D168A_E170A_E331N_L440F_Y441G_R496T_E559N |
| 1823 | Y14D_D168A_E170A_L440F_Y441G |
| 1824 | Y14D_D168A_E170A_C362L_L440F_Y441G_R496T_A515T_R537S_E559N |
| 1825 | Y14N_D168A_E170A_L313M_L440F_Y441G_R496T_E559K |
| 1826 | Y14D_R122S_D168A_E170A_L440F_Y441G_R496T_A515T_R537S_E559N_N759P |
| 1827 | Y14N_R122S_E156N_D168A_E170A_L440F_Y441G_R496T_E559N |
| 1828 | Y14N_D168A_E170A_L440F_Y441G_R496T_A515T_R537S_E559N_N759P |
| 1829 | D168A_E170A_L440Y_Y441G |

FIG. 143-20

Table 6: Wild type NOZ 58130 = SEQ ID NO:1316

| SEQ# | Mutations based on SEQ ID NO:1316 |
|---|---|
| 1830 | Y14D_D168A_E170A_E331N_L440F_Y441G_R496T_R537S_E559N |
| 1831 | Y14D_R122S_E157F_D168A_E170A_L440F_Y441G_R496T_E559K |
| 1832 | Y14D_R122S_E157F_D168A_E170A_L440F_Y441G_R496T_R537S_E559K |
| 1833 | Y14D_D168A_E170A_L440F_Y441G_I480Y_R496T_E559K |
| 1834 | Y14D_R150V_D168A_E170A_L440F_Y441G_R496T_E559K |
| 1835 | Y14F_D168A_E170A_L440F_Y441G_A515V_S522E |
| 1836 | Y14N_D168A_E170A_L440F_Y441G_I480Y_R537S_E559N |
| 1837 | Y14D_R122S_D168A_E170A_C362L_L440F_Y441G_R496T_R537S_E559N |
| 1838 | Y14D_R122S_D168A_E170A_L440F_Y441G_R496T_A515T_E559N |
| 1839 | Y14N_D168A_E170A_L440F_Y441G |
| 1840 | Y14D_D168A_E170A_L440F_Y441G_R496T_E559K |
| 1841 | Y14D_D168A_E170A_L313M_L440F_Y441G_R496T_A515T_R537S_E559N |
| 1842 | Y14N_E156N_D168A_E170A_L440F_Y441G_R496T_E559K |
| 1843 | Y14N_D168A_E170A_V298I_L440F_Y441G_R496T_R537S_E559N |
| 1844 | Y14D_R122S_E157F_D168A_E170A_L440F_Y441G_R496T_R537S_E559K |
| 1845 | Y14N_D168A_E170A_E331N_L440F_Y441G_R537S_E559N |
| 1846 | Y14D_D168A_E170A_C362L_L440F_Y441G_R496T_E559K |
| 1847 | Y14F_D168A_E170A_A515S |

FIG. 143-21

Table 6: Wild type NOZ 58130 = SEQ ID NO:1316

| SEQ# | Mutations based on SEQ ID NO:1316 |
|---|---|
| 1848 | Y14N_R122S_D168A_E170A_L440F_Y441G_A515T_R537S_E559N |
| 1849 | Y14F_D168A_E170A_C362L_L440F_Y441G |
| 1850 | Y14D_D168A_E170A_V298I_L440F_Y441G_R496T_E559N |
| 1851 | Y14D_D168A_E170A_L440F_Y441G_A515T_R537S_E559N |
| 1852 | Y14F_D168A_E170A_V298Y_L440F_Y441G |
| 1853 | Y14F_D168A_E170A_L440F_Y441G_A515T_E559D |
| 1854 | Y14F_D168A_E170A_L440F_Y441G_A515T_S522T |
| 1855 | Y14F_D168A_E170A_L440F_Y441G_R496T_E559K |
| 1856 | Y14F_D168A_E170A_L440F_Y441G_E559K |
| 1857 | Y14F_E157F_D168A_E170A_L440F_Y441G |
| 1858 | Y14N_R122S_R150A_D168A_E170A_L440F_Y441G_R496T_E559N |
| 1859 | Y14F_D168A_E170A_L440F_Y441G_R496T_F523A |
| 1860 | Y14F_D168A_E170A_L440Y_Y441A_A515T |
| 1861 | Y14F_D168A_E170A_L440Y_Y441A_P442G_A515T |
| 1862 | Y14F_D168A_E170A_L440F_Y441G_F523S_E559K |
| 1863 | Y14D_R150A_D168A_E170A_L440F_Y441G_R496T_E559K |
| 1864 | Y14D_R122S_D168A_E170A_L440F_Y441G_A515T_R537S_E559N |
| 1865 | Y14F_D168A_E170A_L440F_Y441G_R496G_E559K |
| 1866 | Y14F_D168A_E170A_L440F_Y441G_T690F |

FIG. 143-22

Table 6: Wild type NOZ 58130 = SEQ ID NO:1316

| SEQ# | Mutations based on SEQ ID NO:1316 |
|---|---|
| 1867 | Y14D_R122S_E157F_D168A_E170A_L440F_Y441G_R496T_E559N |
| 1868 | Y14D_R122S_D168A_E170A_L313M_L440F_Y441G_R496T_E559N |
| 1869 | Y14D_D168A_E170A_C362L_L440F_Y441G_E559K |
| 1870 | Y14N_D168A_E170A_L440F_Y441G_I480F_R496T_R537S_E559K |
| 1871 | Y14F_R122S_D168A_E170A_L440F_Y441G_E559K |
| 1872 | Y14D_E157F_D168A_E170A_L440F_Y441G_R496T_R537S_E559N |
| 1873 | Y14F_D168A_E170A_L440F_Y441G_S698D |
| 1874 | Y14N_E157F_D168A_E170A_L440F_Y441G_R496T_R537S_E559N |
| 1875 | Y14F_D168A_E170A_L440F_Y441G_F523T |
| 1876 | Y14F_V97S_D168A_E170A_L440F_Y441G |
| 1877 | Y14N_E157F_D168A_E170A_L440F_Y441G_R496T_E559K |
| 1878 | Y14D_E157F_D168A_E170A_L440F_Y441G_R496T_R537S_E559K |
| 1879 | Y14F_E157K_D168A_E170A_L440F_Y441G |
| 1880 | Y14D_R122S_E153K_D168A_E170A_L440F_Y441G_R496T_R537S_E559K |
| 1881 | Y14D_R122S_R150A_D168A_E170A_L440F_Y441G_R496T_R537S_E559N |
| 1882 | Y14N_R122S_D168A_E170A_V298I_L440F_Y441G_R496T_A515T_R537S_E559N |
| 1883 | Y14F_D168A_E170A_L440F_Y441G_A515T_F523S |
| 1884 | Y14F_D168A_E170A_L440Y_Y441A |
| 1885 | Y14F_D168A_E170A_L440F_Y441G_N759D |
| 1886 | Y14F_V97F_D168A_E170A_L440F_Y441G |

FIG. 143-23

Table 6: Wild type NOZ 58130 = SEQ ID NO:1316

| SEQ# | Mutations based on SEQ ID NO:1316 |
|---|---|
| 1887 | D168A_E170A |
| 1888 | Y14D_R122S_D168A_E170A_L440F_Y441G_I480F_R496T_E559K |
| 1889 | Y14F_D168A_E170A_L440A_Y441A_P442A_A515S |
| 1890 | Y14N_R122S_R150A_D168A_E170A_L440F_Y441G_R496T_R537S_E559N |
| 1891 | Y14N_D168V_E170V_L440F_Y441G_R537S_E559N |
| 1892 | Y14N_E156N_D168A_E170A_L440F_Y441G_R496T_R537S_E559K |
| 1893 | Y14D_R122S_D168A_E170A_L313M_L440F_Y441G_R496T_E559K |
| 1894 | Y14N_D168V_E170V_L440F_Y441G_R496T_E559N |
| 1895 | Y14D_E153K_D168A_E170A_L440F_Y441G_R496T_E559N |
| 1896 | Y14F_E156N_D168A_E170A_L440F_Y441G |
| 1897 | Y14F_D168A_E170A_L440F_Y441G_Q691F |
| 1898 | Y14N_R122S_D168A_E170A_L440F_Y441G_R537S_E559N |
| 1899 | Y14N_R122S_E157F_D168A_E170A_L440F_Y441G_R496T_E559K |
| 1900 | Y14F_R122S_D168A_E170A_L440F_Y441G_A515T |
| 1901 | Y14F_D168A_E170A_L440F_Y441G_F511Y |
| 1902 | Y14N_D168A_E170A_V298I_L440F_Y441G_R537S_E559N |
| 1903 | Y14F_D168A_E170A_L440Y_Y441G_P442A_A515V |
| 1904 | Y14N_D168A_E170A_L440F_Y441G_A515T_R537S_E559N |
| 1905 | Y14N_R122S_R150A_D168A_E170A_L440F_Y441G_R496T_R537S_E559N |

FIG. 143-24

Table 6: Wild type NOZ 58130 = SEQ ID NO:1316

| SEQ# | Mutations based on SEQ ID NO:1316 |
|---|---|
| 1906 | Y14N_R122S_R150A_D168A_E170A_L440F_Y441G_R496T_E559K |
| 1907 | Y14D_E153K_D168A_E170A_L440F_Y441G_R496T_R537S_E559N |
| 1908 | Y14F_D168A_E170A_L440F_Y441S_E559N |
| 1909 | Y14N_R122S_D168A_E170A_L440F_Y441G_I480Y_R496T_E559N |
| 1910 | Y14N_R122S_D168A_E170A_C362L_L440F_Y441G_R496T_R537S_E559N |
| 1911 | Y14D_D168V_E170V_L440F_Y441G_R537S_E559N |
| 1912 | Y14D_D168A_E170A_L440F_Y441G_R496T_E559N_N759P |
| 1913 | Y14N_E153K_D168A_E170A_L440F_Y441G_R496T_R537S_E559N |
| 1914 | Y14D_E156N_D168A_E170A_L440F_Y441G_R496T_E559N |
| 1915 | Y14F_D168A_E170A_C362I_L440F_Y441G |
| 1916 | Y14F_D168A_E170A_L440Y_Y441A_A515S |
| 1917 | Y14F_D168A_E170A_L440F_Y441G_A515V_S522K |
| 1918 | Y14F_D168A_E170A_L440F_Y441G_R496T_R537S_E559N |
| 1919 | Y14D_R150V_D168A_E170A_L440F_Y441G_R496T_E559K |
| 1920 | Y14N_E157F_D168A_E170A_L440F_Y441G_R496T_E559N |
| 1921 | Y14N_R122S_D168A_E170A_L440F_Y441G_R496T_R537S_E559N |
| 1922 | Y14N_D168A_E170A_L440F_Y441G_I480Y_R496T_R537S_E559N |
| 1923 | Y14F_D168A_E170A_E311A_L440F_Y441G |
| 1924 | Y14D_E157F_D168A_E170A_L440F_Y441G_R496T_E559N |

FIG. 143-25

Table 6: Wild type NOZ 58130 = SEQ ID NO:1316

| SEQ# | Mutations based on SEQ ID NO:1316 |
|---|---|
| 1925 | Y14N_D168A_E170A_L440F_Y441G_A515T_R537S_E559K |
| 1926 | Y14F_E156R_D168A_E170A_L440F_Y441G |
| 1927 | Y14D_E156N_D168A_E170A_L440F_Y441G_R496T_E559K |
| 1928 | Y14F_D168A_E170A_L440F_Y441G_F523I |
| 1929 | Y14F_D168A_E170A_L440F_Y441G_T693F |
| 1930 | Y14N_R122S_R150V_D168A_E170A_L440F_Y441G_R496T_A515T_R537S_E559K |
| 1931 | Y14D_R122S_D168V_E170V_L440F_Y441G_R496T_R537S_E559K |
| 1932 | Y14D_R122S_D168A_E170A_L440F_Y441G_R496T_E559K |
| 1933 | Y14D_R122S_D168A_E170A_L440F_Y441G_I480Y_R496T_E559K |
| 1934 | Y14F_D168A_E170A_H297A_L440F_Y441G |
| 1935 | Y14N_R122S_R150A_D168A_E170A_L440F_Y441G_R496T_R537S_E559K |
| 1936 | Y14F_R122S_D168A_E170A_L440F_Y441G_R496T_R537S_E559N |
| 1937 | Y14D_R122S_E157F_D168A_E170A_L440F_Y441G_R496T_A515T_R537S_E559N |
| 1938 | Y14F_D168A_E170A_C362S_L440F_Y441G |
| 1939 | Y14D_R122S_D168A_E170A_L440F_Y441G_R496T_A515T_E559K |
| 1940 | Y14F_D168A_E170A_L440Y_Y441A_P442G |
| 1941 | Y14D_R122S_R150A_D168A_E170A_L440F_Y441G_R496T_A515T_R537S_E559N |
| 1942 | Y14F_R122K_D168A_E170A_L440F_Y441G_A515V |
| 1943 | Y14D_R122S_R150V_D168A_E170A_L440F_Y441G_R496T_A515T_R537S_E559N |

FIG. 143-26

Table 6: Wild type NOZ 58130 = SEQ ID NO:1316

| SEQ# | Mutations based on SEQ ID NO:1316 |
|---|---|
| 1944 | Y14N_R122S_D168A_E170A_L440F_Y441G_E559N |
| 1945 | Y14F_R122K_D168A_E170A_L440F_Y441G_A515T |
| 1946 | Y14F_R122D_D168A_E170A_L440F_Y441G_A515V |
| 1947 | Y14N_R150A_D168A_E170A_L440F_Y441G_R496T_R537S_E559K |
| 1948 | Y14N_D168V_E170V_L440F_Y441G_R496T_R537S_E559N |
| 1949 | Y14F_D168A_E170A_L440F_Y441G_R496A_E559N |
| 1950 | Y14D_R122S_R150V_D168A_E170A_L440F_Y441G_R496T_R537S_E559N |
| 1951 | Y14N_R122S_D168A_E170A_L440F_Y441G_R496T_E559N_N759P |
| 1952 | Y14D_R150V_D168A_E170A_L440F_Y441G_R496T_A515T_R537S_E559N |
| 1953 | Y14F_D168A_E170A_L440Y_Y441G_A515T |
| 1954 | Y14F_D168A_E170A_L440F_Y441G_D671R |
| 1955 | Y14N_R150A_D168A_E170A_L440F_Y441G_R496T_R537S_E559K |
| 1956 | Y14F_D168A_E170A_L440F_Y441G_R537E_E559N |
| 1957 | Y14N_R122S_D168A_E170A_L440F_Y441G_I480Y_R496T_E559K |
| 1958 | Y14F_D168A_E170A_L440F_Y441G_R496T_E559N |
| 1959 | Y14D_R122S_E156N_D168A_E170A_L440F_Y441G_R496T_A515T_R537S_E559N |
| 1960 | Y14F_D168A_E170A_L440F_Y441G_A515V_R537G |
| 1961 | Y14F_D168A_E170A_L360I_L440F_Y441G |

FIG. 143-27

Table 6: Wild type NOZ 58130 = SEQ ID NO:1316

| SEQ# | Mutations based on SEQ ID NO:1316 |
|---|---|
| 1962 | Y14D_D168A_E170A_C362L_L440F_Y441G_R496T_E559N |
| 1963 | Y14D_R122S_D168A_E170A_V298I_L440F_Y441G_R496T_R537S_E559K |
| 1964 | Y14F_D168A_E170A_L440Y_Y441G_P442A_A515T |
| 1965 | Y14D_D168A_E170A_L440F_Y441G_R496T_A515T_R537S_E559K |
| 1966 | Y14F_E157L_D168A_E170A_L440F_Y441G |
| 1967 | Y14F_D168A_E170A_E406N_L440F_Y441G |
| 1968 | Y14D_D168A_E170A_L440F_Y441G_R496T_A515T_R537S_E559N |
| 1969 | Y14D_E157F_D168A_E170A_L440F_Y441G_R496T_E559K |
| 1970 | Y14F_D168A_E170A_E184N_L440F_Y441G |
| 1971 | Y14F_D168A_E170A_C362F_L440F_Y441G |
| 1972 | Y14F_D168A_E170A_L440F_Y441G_C539S |
| 1973 | Y14D_R122S_D168A_E170A_V298I_L440F_Y441G_R496T_E559K |
| 1974 | Y14D_E156N_D168A_E170A_L440F_Y441G_R496T_R537S_E559N |
| 1975 | Y14D_R122S_D168A_E170A_L440F_Y441G_R496T_R537S_E559N_N759P |
| 1976 | Y14F_D168A_E170A_L440F_Y441G_S522E |
| 1977 | Y14F_D168A_E170A_E406N_E407N_L440F_Y441G |
| 1978 | Y14N_R122S_D168A_E170A_V298I_L440F_Y441G_R496T_E559N |
| 1979 | Y14N_R122S_E153K_D168A_E170A_L440F_Y441G_R496T_E559K |
| 1980 | Y14D_E153K_D168A_E170A_L440F_Y441G_R496T_A515T_R537S_E559N |

FIG. 143-28

Table 6: Wild type NOZ 58130 = SEQ ID NO:1316

| SEQ# | Mutations based on SEQ ID NO:1316 |
|---|---|
| 1981 | Y14F_D168A_E170A_L440F_Y441G_A515V_R537K |
| 1982 | Y14F_D168A_E170A_L440F_Y441G_T693P |
| 1983 | Y14D_D168A_E170A_L440F_Y441G_A515T_R537S_E559K |
| 1984 | Y14D_R150A_D168A_E170A_L440F_Y441G_R496T_R537S_E559N |
| 1985 | Y14F_D168Y_E170A_L440F_Y441G |
| 1986 | Y14D_D168V_E170V_L440F_Y441G_R496T_R537S_E559K |
| 1987 | Y14F_D168A_E170A_C362A_L440F_Y441G |
| 1988 | Y14D_D168A_E170A_L440F_Y441G_I480Y_R496T_E559N |
| 1989 | Y14N_D168A_E170A_L440F_Y441G_R537S_E559K |
| 1990 | Y14D_R122S_R150V_D168A_E170A_L440F_Y441G_R496T_R537S_E559K |
| 1991 | Y14F_D168A_E170A_H297T_L440F_Y441G |
| 1992 | Y14N_R150A_D168A_E170A_L440F_Y441G_R496T_E559K |
| 1993 | Y14D_D168A_E170A_E331N_L440F_Y441G_R496T_R537S_E559K |
| 1994 | Y14N_R122S_D168A_E170A_C362L_L440F_Y441G_R496T_R537S_E559K |
| 1995 | Y14F_D168A_E170A_L364I_L440F_Y441G |
| 1996 | Y14D_R122S_E153K_D168A_E170A_L440F_Y441G_R496T_E559K |
| 1997 | Y14N_R122S_E156N_D168A_E170A_L440F_Y441G_R496T_A515T_R537S_E559N |
| 1998 | Y14F_D168A_E170A_L440F_Y441G_K628D |
| 1999 | Y14F_D168A_E170A_L440F_Y441G_S522N |
| 2000 | Y14D_D168A_E170A_L440F_Y441G_I480F_R496T_E559K |

FIG. 143-29

Table 6: Wild type NOZ 58130 = SEQ ID NO:1316

| SEQ# | Mutations based on SEQ ID NO:1316 |
|---|---|
| 2001 | Y14D_R122S_D168A_E170A_L440F_Y441G_R496T_E559K_N759P |
| 2002 | Y14F_E108R_D168A_E170A_L440F_Y441G |
| 2003 | Y14F_D168A_E170A_L440F_Y441G_A720D |
| 2004 | Y14F_R122S_D168A_E170A_L440F_Y441G_R496T_E559N |
| 2005 | Y14N_D168A_E170A_L440F_Y441G_R496T_E559N |
| 2006 | D168A_E170A_L440Y_Y441A |
| 2007 | Y14F_D168A_E170A_L440F_Y441G_N759T |
| 2008 | Y14F_D168A_E170Y_L440F_Y441G |
| 2009 | Y14N_D168A_E170A_V298I_L440F_Y441G_R496T_E559N |
| 2010 | Y14N_E157F_D168A_E170A_L440F_Y441G_R496T_R537S_E559N |
| 2011 | Y14F_D168A_E170A_L440F_Y441G_R496T_A515T_R537S_E559N |
| 2012 | Y14F_E108N_D168A_E170A_L440F_Y441G |
| 2013 | Y14D_D168V_E170V_L440F_Y441G_R496T_R537S_E559N |
| 2014 | Y14D_R122S_D168V_E170V_L440F_Y441G_R496T_E559N |
| 2015 | Y14F_D168A_E170A_L440F_Y441G_S522D_E559K |
| 2016 | Y14N_D168A_E170A_L440F_Y441G_I480Y_R496T_R537S_E559K |
| 2017 | Y14N_R122S_E153K_D168A_E170A_L440F_Y441G_R496T_R537S_E559K |
| 2018 | Y14N_D168A_E170A_L313M_L440F_Y441G_R496T_E559N |
| 2019 | Y14D_R122S_D168A_E170A_L440F_Y441G_E559N |

FIG. 143-30

Table 6: Wild type NOZ 58130 = SEQ ID NO:1316

| SEQ# | Mutations based on SEQ ID NO:1316 |
|---|---|
| 2020 | Y14N_R122S_D168A_E170A_L440F_Y441G_R496T_A515T_R537S_E559K |
| 2021 | Y14F_D168A_E170A_L440Y_Y441G_P442A_A515L |
| 2022 | Y14N_R122S_D168A_E170A_L440F_Y441G_A515T_E559N |
| 2023 | Y14N_R122S_D168A_E170A_V298I_L440F_Y441G_R496T_R537S_E559K |
| 2024 | Y14F_D168L_E170A_L440F_Y441G |
| 2025 | Y14F_D168A_E170A_C362Y_L440F_Y441G |
| 2026 | Y14F_D168A_E170A_L440F_Y441G_S522K |
| 2027 | Y14D_D168A_E170A_L440F_Y441G_I480F_R537S_E559N |
| 2028 | Y14N_D168A_E170A_C362L_L440F_Y441G_R496T_E559N |
| 2029 | Y14F_D168A_E170A_H297F_L440F_Y441G |
| 2030 | Y14D_D168A_E170A_L440F_Y441G_I480F_R496T_R537S_E559N |
| 2031 | Y14D_D168A_E170A_L440F_Y441G_R496T_R537S_E559K_N759P |
| 2032 | Y14D_R150V_D168A_E170A_L440F_Y441G_R496T_E559N |
| 2033 | Y14F_E153K_D168A_E170A_L440F_Y441G |
| 2034 | Y14N_D168A_E170A_L440F_Y441G_R537S_E559N_N759P |
| 2035 | Y14F_D168A_E170A_L440F_Y441G_A515T_R537E |
| 2036 | Y14F_D168A_E170A_L440F_Y441A_P442G_A515V |
| 2037 | Y14F_D168A_E170A_L388Y_L440F_Y441G |
| 2038 | Y14D_R122S_R150A_D168A_E170A_L440F_Y441G_R496T_E559K |

FIG. 143-31

Table 6: Wild type NOZ 58130 = SEQ ID NO:1316

| SEQ# | Mutations based on SEQ ID NO:1316 |
|---|---|
| 2039 | Y14N_R150A_D168A_E170A_L440F_Y441G_R496T_E559N |
| 2040 | Y14F_D168A_E170A_L440F_Y441G_F511H |
| 2041 | Y14D_D168A_E170A_L440F_Y441G_R537S_E559N |
| 2042 | Y14N_R150V_D168A_E170A_L440F_Y441G_R496T_R537S_E559K |
| 2043 | Y14N_R122S_D168V_E170V_L440F_Y441G_R496T_R537S_E559N |
| 2044 | Y14D_E153K_D168A_E170A_L440F_Y441G_R496T_A515T_R537S_E559K |
| 2045 | Y14D_R122S_E153K_D168A_E170A_L440F_Y441G_R496T_A515T_R537S_E559K |
| 2046 | Y14F_R122G_D168A_E170A_L440F_Y441G_A515T |
| 2047 | Y14D_R122S_D168A_E170A_L440F_Y441G_I480Y_R496T_E559N |
| 2048 | Y14D_D168A_E170A_E331N_L440F_Y441G_R496T_E559K |
| 2049 | Y14D_D168V_E170V_L440F_Y441G_R496T_E559N |
| 2050 | Y14N_R122S_D168V_E170V_L440F_Y441G_R496T_E559N |
| 2051 | Y14F_R122G_D168A_E170A_L440F_Y441G_A515V |
| 2052 | Y14N_D168A_E170A_L313M_L440F_Y441G_R537S_E559N |
| 2053 | Y14F_D168A_E170A_H297Y_L440F_Y441G |
| 2054 | Y14D_R122S_E153K_D168A_E170A_L440F_Y441G_R496T_R537S_E559N |
| 2055 | Y14F_V97Y_D168A_E170A_L440F_Y441G |
| 2056 | Y14N_D168A_E170A_E331N_L440F_Y441G_E559K |

FIG. 143-32

Table 6: Wild type NOZ 58130 = SEQ ID NO:1316

| SEQ# | Mutations based on SEQ ID NO:1316 |
|---|---|
| 2057 | Y14F_D168A_E170A_L440A_Y441A_P442A_A515L |
| 2058 | Y14F_D168A_E170A_L440Y_Y441G_P442A_A515S |
| 2059 | Y14D_R122S_D168A_E170A_L440F_Y441G_R537S_E559K |
| 2060 | Y14N_R122S_D168A_E170A_L440F_Y441G_I480F_R496T_R537S_E559N |
| 2061 | Y14N_R122S_D168A_E170A_L440F_Y441G_R496T_E559K |
| 2062 | Y14N_R122S_D168A_E170A_L440F_Y441G_I480Y_R496T_A515T_R537S_E559N |
| 2063 | Y14D_D168A_E170A_V298I_L440F_Y441G_R537S_E559N |
| 2064 | Y14D_R122S_E157F_D168A_E170A_L440F_Y441G_R496T_R537S_E559N |
| 2065 | Y14D_D168A_E170A_L313M_L440F_Y441G_R496T_R537S_E559K |
| 2066 | Y14N_R122S_D168A_E170A_E331N_L440F_Y441G_R496T_A515T_R537S_E559N |
| 2067 | Y14N_D168A_E170A_C362L_L440F_Y441G_R496T_E559K |
| 2068 | Y14F_D168A_E170A_L440F_Y441G_E703S |
| 2069 | Y14F_D168A_E170A_L440F_Y441G_M555I |
| 2070 | Y14F_D168A_E170A_L440F_Y441G_E703R |
| 2071 | Y14F_W135R_D168A_E170A_L440F_Y441G |
| 2072 | Y14F_D168A_E170A_A276Q_L440F_Y441G |
| 2073 | Y14N_R122S_E157F_D168A_E170A_E331N_L440F_Y441G_R537S_E559N |
| 2074 | Y14F_D168A_E170A_A352D_C362L_L440F_Y441G |
| 2075 | Y14N_R122S_D168V_E170V_L440F_Y441G_R537S_E559N |

FIG. 143-33

Table 6: Wild type NOZ 58130 = SEQ ID NO:1316

| SEQ# | Mutations based on SEQ ID NOS: 1316 |
|---|---|
| 2076 | Y14N_R122S_R150A_D168A_E170A_Y408R_L440F_Y441G_R496T_R537S_E559N |
| 2077 | Y14D_D168A_E170A_E331N_L440F_Y441G_A515T_R537S_E559N |
| 2078 | Y14F_D168A_E170A_R422T_L440F_Y441G |
| 2079 | Y14F_D168A_E170A_L440F_Y441G_C539N |
| 2080 | Y14N_R122S_E157F_D168A_E170A_L440F_Y441G_I480Y_R537S_E559N |
| 2081 | Y14F_D168A_E170A_C362K_L440F_Y441G |
| 2082 | Y14N_R122S_R150V_D168A_E170A_E331N_L440F_Y441G_R496T_R537S_E559N |
| 2083 | Y14N_D168A_E170A_C362L_L440F_Y441G_A515T_R537S_E559N |
| 2084 | Y14N_D168A_E170A_E331N_L440F_Y441G_A515T_R537S_E559N |
| 2085 | Y14N_R122S_E157F_D168V_E170V_L440F_Y441G_R537S_E559N |
| 2086 | Y14N_R150V_D168A_E170A_E331N_L440F_Y441G_R496T_A515T_R537S_E559N |
| 2087 | Y14D_R150A_D168A_E170A_E331N_L440F_Y441G_R496T_A515T_R537S_E559N |
| 2088 | Y14F_D168A_E170A_R413Q_L440F_Y441G |
| 2089 | Y14F_D168A_E170A_C362N_L440F_Y441G |
| 2090 | Y14D_D168A_E170A_L313M_L440F_Y441G_A515T_R537S_E559N |
| 2091 | Y14F_D168A_E170A_A352Q_L440F_Y441G |
| 2092 | Y14N_R122S_E157F_D168A_E170A_L313M_L440F_Y441G_R537S_E559N |
| 2093 | Y14N_R122S_R150V_D168A_E170A_C362L_L440F_Y441G_R537S_E559K |
| 2094 | Y14F_D168A_E170A_K319V_C362L_L440F_Y441G |
| 2095 | Y14F_D168A_E170A_L440F_Y441G_G735T |

FIG. 143-34

Table 6: Wild type NOZ 58130 = SEQ ID NO:1316

| SEQ# | Mutations based on SEQ ID NOS: 1316 |
|---|---|
| 2096 | Y14N_R122S_R150V_D168A_E170A_L440F_Y441G_I480Y_R537S_E559K |
| 2097 | Y14F_D168A_E170A_L440F_Y441G_C539P |
| 2098 | Y14N_R122S_E157F_D168A_E170A_C362L_L440F_Y441G_R537S_E559N |
| 2099 | Y14N_R122S_E157A_D168A_E170A_E331N_L440F_Y441G_R496T_R537S_E559N |
| 2100 | Y14N_E157A_D168A_E170A_L313M_L440F_Y441G_R496T_A515T_R537S_E559N |
| 2101 | Y14N_R122S_D168A_E170A_L313M_L440F_Y441G_R537S_E559N |
| 2102 | Y14N_D168A_E170A_L313M_L440F_Y441G_A515T_R537S_E559N |
| 2103 | Y14F_D168A_E170A_R422D_L440F_Y441G |
| 2104 | Y14N_R122S_R150A_D168A_E170A_C362L_L440F_Y441G_R537S_E559N |
| 2105 | Y14N_R122S_E157F_D168A_E170A_L440F_Y441G_I480F_R537S_E559N |
| 2106 | Y14F_D168A_E170A_L440F_Y441G_S701E |
| 2107 | Y14N_R122S_R150A_D168A_E170A_L440F_Y441G_R496T_R537S_E559N_Y774^ |
| 2108 | Y14N_R122S_R150A_D168A_E170A_L440F_Y441G_R496T_R537S_E559N_G773^ |
| 2109 | Y14N_R122S_R150V_D168A_E170A_C362L_L440F_Y441G_R496T_R537S_E559N |
| 2110 | Y14F_D168A_E170A_L440F_Y441G_Q738D |
| 2111 | Y14F_D168A_E170A_Y408R_L440F_Y441G |
| 2112 | Y14F_D168A_E170A_L440F_Y441G_S701T |
| 2113 | Y14N_R122S_R150A_D168A_E170A_L313M_L440F_Y441G_R537S_E559N |
| 2114 | Y14N_R122S_D168A_E170A_C362L_L440F_Y441G_R537S_E559N |
| 2115 | Y14F_D168A_E170A_L338E_L440F_Y441G |

FIG. 143-35

Table 6: Wild type NOZ 58130 = SEQ ID NO:1316

| SEQ# | Mutations based on SEQ ID NOS: 1316 |
|---|---|
| 2116 | Y14N_R150V_D168A_E170A_C362L_L440F_Y441G_R496T_A515T_R537S_E559N |
| 2117 | Y14F_W135L_D168A_E170A_L440F_Y441G |
| 2118 | Y14F_D168A_E170A_L440F_Y441G_G773^ |
| 2119 | Y14N_R122S_R150A_D168V_E170V_L440F_Y441G_R537S_E559N |
| 2120 | Y14F_D168A_E170A_F326N_L440F_Y441G |
| 2121 | Y14D_E157A_D168A_E170A_E331N_L440F_Y441G_R496T_A515T_R537S_E559N |
| 2122 | Y14N_R122S_R150A_D168A_E170A_L440F_Y441G_R496T_R537S_E559N_R790^ |
| 2123 | Y14F_D168A_E170A_L277M_L440F_Y441G |
| 2124 | Y14F_D168A_E170A_L440F_Y441G_Y774^ |
| 2125 | Y14N_R122S_R150V_D168A_E170A_C362L_L440F_Y441G_R496T_R537S_E559K |
| 2126 | Y14N_R122S_E157F_D168A_E170A_L440F_Y441G_R537S_E559N_N759P |
| 2127 | Y14N_R122S_D168A_E170A_V298I_L440F_Y441G_R537S_E559N |
| 2128 | Y14F_D168A_E170A_L440F_Y441G_G735E |
| 2129 | Y14N_E157A_D168A_E170A_E331N_L440F_Y441G_R496T_A515T_R537S_E559N |
| 2130 | Y14F_D168A_E170A_V288F_C362L_L440F_Y441G |
| 2131 | Y14F_D168A_E170A_C362D_L440F_Y441G |
| 2132 | Y14F_D168A_E170A_L440F_Y441G_R767E |
| 2133 | Y14N_R122S_R150A_D168A_E170A_E331N_L440F_Y441G_R537S_E559N |
| 2134 | Y14D_R150A_D168A_E170A_C362L_L440F_Y441G_R496T_R537S_E559N |
| 2135 | Y14F_D168A_E170A_L290I_L440F_Y441G |

FIG. 143-36

Table 6: Wild type NOZ 58130 = SEQ ID NO:1316

| SEQ# | Mutations based on SEQ ID NOS: 1316 |
|---|---|
| 2136 | Y14F_D168A_E170A_L440F_Y441G_C539D |
| 2137 | Y14D_R150A_D168A_E170A_L313M_L440F_Y441G_R496T_A515T_R537S_E559N |
| 2138 | Y14N_R122S_R150V_D168A_E170A_V298I_L440F_Y441G_R537S_E559K |
| 2139 | Y14N_R122S_E157A_D168A_E170A_C362L_L440F_Y441G_R496T_R537S_E559N |
| 2140 | Y14F_D117(del)_D168A_E170A_L440F_Y441G |
| 2141 | Y14N_R122S_R150V_D168V_E170V_L440F_Y441G_R537S_E559K |
| 2142 | Y14F_D168A_E170A_L440F_Y441G_S737R |
| 2143 | Y14F_D168A_E170A_L440F_Y441G_R619E |
| 2144 | Y14N_R122S_R150A_D168A_E170A_L440F_Y441G_I480F_R537S_E559N |
| 2145 | Y14N_R122S_R150V_D168A_E170A_V298I_L440F_Y441G_R496T_R537S_E559N |
| 2146 | Y14F_D168A_E170A_A276M_L440F_Y441G |
| 2147 | Y14F_D168A_E170A_L440F_Y441G_G735S |
| 2148 | Y14F_D168A_E170A_L440F_Y441G_Q785^ |
| 2149 | Y14F_D168A_E170A_C362L_L440F_Y441G_L585K |
| 2150 | Y14N_R122S_R150V_D168A_E170A_L440F_Y441G_R537S_E559K_N759P |
| 2151 | Y14N_R150A_D168A_E170A_C362L_L440F_Y441G_R496T_A515T_R537S_E559N |
| 2152 | Y14F_D168A_E170A_L440F_Y441G_S701R |
| 2153 | Y14N_R122S_R150V_D168A_E170A_L313M_L440F_Y441G_R496T_R537S_E559N |
| 2154 | Y14N_R122S_R150A_D168A_E170A_L440F_Y441G_R496T_R537S_E559N_Q785^ |
| 2155 | Y14F_D168A_E170A_L440F_Y441G_M723N |

FIG. 143-37

Table 6: Wild type NOZ 58130 = SEQ ID NO:1316

| SEQ# | Mutations based on SEQ ID NOS: 1316 |
|---|---|
| 2156 | Y14N_R122S_E157A_D168A_E170A_L313M_L440F_Y441G_R496T_R537S_E559N |
| 2157 | Y14N_R122S_R150A_D168A_E170A_L440F_Y441G_R537S_E559N_N759P |
| 2158 | Y14F_D168A_E170A_L440F_Y441G_M723T |
| 2159 | Y14F_D168A_E170A_L440F_Y441G_D758N |
| 2160 | Y14F_D168A_E170A_A276N_L440F_Y441G |
| 2161 | Y14N_R122S_W135R_R150A_D168A_E170A_L440F_Y441G_R496T_R537S_E559N |
| 2162 | Y14N_E157A_D168A_E170A_C362L_L440F_Y441G_R496T_A515T_R537S_E559N |
| 2163 | Y14N_R122S_R150V_D168A_E170A_E331N_L440F_Y441G_R537S_E559K |
| 2164 | Y14N_R150A_D168A_E170A_E331N_L440F_Y441G_R496T_A515T_R537S_E559N |
| 2165 | Y14F_D168A_E170A_C362P_L440F_Y441G |
| 2166 | Y14F_D168A_E170A_L440F_Y441G_G735P |
| 2167 | Y14F_D168A_E170A_C362L_L440F_Y441G_Y774^ |
| 2168 | Y14N_R122S_W135S_R150A_D168A_E170A_L440F_Y441G_R496T_R537S_E559N |
| 2169 | Y14N_R150A_D168A_E170A_L313M_L440F_Y441G_R496T_A515T_R537S_E559N |
| 2170 | Y14F_W135S_D168A_E170A_L440F_Y441G |
| 2171 | Y14N_R122S_E157A_D168A_E170A_V298I_L440F_Y441G_R496T_R537S_E559N |
| 2172 | Y14N_R122S_D168A_E170A_E331N_L440F_Y441G_R537S_E559N |
| 2173 | Y14F_D168A_E170A_R411D_L440F_Y441G |
| 2174 | Y14F_D168A_E170A_D330N_C362L_L440F_Y441G |
| 2175 | Y14F_D168A_E170A_L440F_Y441G_F523Y |

FIG. 143-38

Table 6: Wild type NOZ 58130 = SEQ ID NO:1316

| SEQ# | Mutations based on SEQ ID NOS: 1316 |
|---|---|
| 2176 | Y14N_R122S_W135L_R150A_D168A_E170A_L440F_Y441G_R496T_R537S_E559N |
| 2177 | Y14F_D168A_E170A_L440F_Y441G_V566N |
| 2178 | Y14N_R150V_D168A_E170A_L313M_L440F_Y441G_R496T_A515T_R537S_E559N |
| 2179 | Y14N_R122S_R150A_D168A_E170A_L440F_Y441G_I480Y_R537S_E559N |
| 2180 | Y14D_R150V_D168A_E170A_E331N_L440F_Y441G_R496T_A515T_R537S_E559N |
| 2181 | Y14D_R150V_D168A_E170A_C362L_L440F_Y441G_R496T_R537S_E559N |
| 2182 | Y14F_D168A_E170A_L440F_Y441G_D777^ |
| 2183 | Y14N_R122S_R150V_D168V_E170V_L440F_Y441G_R496T_R537S_E559N |
| 2184 | Y14D_R150V_D168A_E170A_L313M_L440F_Y441G_R496T_A515T_R537S_E559N |
| 2185 | Y14F_D168A_E170A_D330E_C362L_L440F_Y441G |
| 2186 | Y14N_R122S_R150A_D168A_E170A_L440F_Y441G_R496T_R537S_E559N_W791R_F792^ |
| 2187 | Y14F_D168A_E170A_L440F_Y441G_D752Q |
| 2188 | Y14F_D168A_E170A_L277R_L440F_Y441G |
| 2189 | Y14F_D168A_E170A_R422V_L440F_Y441G |
| 2190 | Y14F_D168A_E170A_L338E_C362L_L440F_Y441G |
| 2191 | Y14D_E157A_D168A_E170A_L313M_L440F_Y441G_R496T_A515T_R537S_E559N |
| 2192 | Y14F_D168A_E170A_M378R_L440F_Y441G |
| 2193 | Y14N_R122S_R150A_D168A_E170A_V298I_L440F_Y441G_R537S_E559N |
| 2194 | Y14N_R122S_R150V_D168A_E170A_L313M_L440F_Y441G_R537S_E559K |
| 2195 | Y14F_D168A_E170A_L440F_Y441G_M555Y |

FIG. 143-39

Table 6: Wild type NOZ 58130 = SEQ ID NO:1316

| SEQ# | Mutations based on SEQ ID NOS: 1316 |
|---|---|
| 2196 | Y14F_D168A_E170A_E407R_L440F_Y441G |
| 2197 | Y14F_E76Q_D168A_E170A_C362L_L440F_Y441G |
| 2198 | Y14F_D168A_E170A_L440F_Y441G_S737E |
| 2199 | Y14D_E157A_D168A_E170A_C362L_L440F_Y441G_R496T_R537S_E559N |
| 2200 | Y14F_D168A_E170A_L440F_Y441G_R790^ |
| 2201 | Y14F_D168A_E170A_M378A_L440F_Y441G |
| 2202 | Y14N_R122S_R150A_D168A_E170A_L440F_Y441G_R496T_R537S_E559N_W791R_F792R |
| 2203 | Y14F_D168A_E170A_G275S_L440F_Y441G |
| 2204 | Y14F_D168A_E170A_L440F_Y441G_Q738E |
| 2205 | Y14N_R122S_E157F_D168A_E170A_V298I_L440F_Y441G_R537S_E559N |
| 2206 | Y14F_D168A_E170A_M378T_L440F_Y441G |
| 2207 | Y14F_D168A_E170A_R413T_L440F_Y441G |
| 2208 | Y14F_D168A_E170A_L440F_Y441G_Q738S |
| 2209 | Y14F_D168A_E170A_L440F_Y441G_C539K |
| 2210 | Y14F_D168A_E170A_L440F_Y441G_E565S |
| 2211 | Y14F_D168A_E170A_L440F_Y441G_D752T |
| 2212 | Y14N_R122S_R150A_D168A_E170A_L440F_Y441G_R496T_R537S_E559N_D777^ |
| 2213 | Y14N_R122S_R150V_D168A_E170A_L440F_Y441G_I480F_R537S_E559K |
| 2214 | Y14N_R122S_E157A_D168V_E170V_L440F_Y441G_R496T_R537S_E559N |

FIG. 143-40

Table 7: Wild type RMF 90817 = SEQ ID NO:2215

| SEQ# | Mutations based on SEQ ID NO:2215 | Incorp'n |
|---|---|---|
| 2216 | D149A_E151A_L421Y_Y422G_P423A | + |
| 2217 | D149A_E151A_L421S_Y422G | 0 |
| 2218 | D149A_E151A_L421A_Y422A_P423G | + |
| 2219 | D149A_E151A_L421F_Y422G | + |
| 2220 | D149A_E151A_L421S_Y422G_P423A | 0 |
| 2221 | D149A_E151A_L421S_Y422A_P423G | 0 |
| 2222 | D149A_E151A_L421S_Y422A | + |
| 2223 | D149A_E151A_L421F_Y422A_P423G | ++ |
| 2224 | D149A_E151A_L421A_Y422G_P423A | 0 |
| 2225 | D149A_E151A_L421A_Y422A_P423A | + |
| 2226 | D149A_E151A_L421Y_Y422A_P423G | 0 |
| 2227 | D149A_E151A_L421F_Y422A | ++ |
| 2228 | D149A_E151A_L421Y_Y422A | ++ |
| 2229 | D149A_E151A_L421F_Y422G_P423A | + |
| 2230 | D149A_E151A_L421A_Y422G | + |
| 2231 | D149A_E151A_L421Y_Y422G_T525S | + |
| 2232 | D149A_E151A_L421Y_Y422G | + |
| 2233 | D149A_E151A_L421S_Y422A_P423A | + |
| 2234 | D149A_E151A_L421A_Y422A | + |
| 2235 | D149A_E151A_L421F_Y422A_P423A | + |
| 2236 | D149A_E151A_L421Y_Y422A_P423A | 0 |

FIG. 144-1

Table 8: Wild type RMF 90817 = SEQ ID NO:2215

| SEQ# | Mutations based on SEQ ID NO:2215 |
|---|---|
| 2237 | D149A_E151A_Y272A_C307A_L421F_Y422A_C520A_T525S |
| 2238 | D149A_E151A_C307V_L421Y_Y422G_T525S |
| 2239 | D149A_E151A_C307V_L421F_Y422G_T525S |
| 2240 | D149A_E151A_L421A_Y422A_T525A |
| 2241 | D149A_E151A_L421Y_Y422A_T525S_S523A |
| 2242 | D149A_E151A_Y272A_C307V_L421F_Y422G_T525S |
| 2243 | D149A_E151A_L421S_Y422A_T525A |
| 2244 | D149A_E151A_L421F_Y422G_T525A |
| 2245 | D149A_E151A_L421Y_Y422A_T525A |
| 2246 | D149A_E151A_L421A_Y422A_T525S |
| 2247 | D149A_E151A_L421F_Y422A_T525S |
| 2248 | D149A_E151A_Y272A_C307A_L421F_Y422G_T525S |
| 2249 | D149A_E151A_L421S_Y422A_A496S |
| 2250 | D149A_E151A_L421F_Y422G_A496T |
| 2251 | D149A_E151A_Y272A_C307V_L421Y_Y422G_C520A_T525S |
| 2252 | D149A_E151A_L421S_Y422A_T525S |
| 2253 | Y11F_D149A_E151A_C307A_L421F_Y422G_C520A_T525S |
| 2254 | Y11F_D149A_E151A_L421A_Y422A |
| 2255 | Y11F_D149A_E151A_L421F_Y422A |
| 2256 | Y11F_D149A_E151A_C307A_L421Y_Y422G_T525S |
| 2257 | D149A_E151A_Y272A_Y422A |
| 2258 | D149A_E151A_L421A_Y422A_P423G_A496V |
| 2259 | D149A_E151A_L421S_Y422A_P423A_T525S_S523A |
| 2260 | D149A_E151A_L421F_Y422A_P423A_T525A |

FIG. 145-1

Table 8: Wild type RMF 90817 = SEQ ID NO:2215

| SEQ# | Mutations based on SEQ ID NO:2215 |
|---|---|
| 2261 | D149A_E151A_L421A_Y422A_A496L |
| 2262 | D149A_E151A_L421Y_Y422G_A496S |
| 2263 | D149A_E151A_L421F_Y422A_P423G_A496V |
| 2264 | D149A_E151A_L421S_Y422A_P423A_A496S |
| 2265 | D149A_E151A_L421F_Y422A_P423A_A496V |
| 2266 | D149A_E151A_L421A_Y422A_T525S_S523A |
| 2267 | D149A_E151A_Y272A_C307A_L421F_Y422A_T525S |
| 2268 | D149A_E151A_C307V_L421F_Y422A_C520A_T525S |
| 2269 | Y11F_D149A_E151A_Y272A_C307A_L421Y_Y422G_T525S |
| 2270 | D149A_E151A_C307V_L421F_Y422G_C520A_T525S |
| 2271 | D149A_E151A_L421A_Y422A_P423G_T525A |
| 2272 | D149A_E151A_L421F_Y422G_A496V |
| 2273 | D149A_E151A_L421S_Y422A_A496T |
| 2274 | Y11F_D149A_E151A_C307V_L421F_Y422A_C520A_T525S |
| 2275 | D149A_E151A_L421F_Y422A_P423G_A496L |
| 2276 | Y11F_D149A_E151A_Y272A_C307V_L421F_Y422G_T525S |
| 2277 | D149A_E151A_L421Y_Y422A_A496T |
| 2278 | Y11F_D149A_E151A_L421Y_Y422G |
| 2279 | D149A_E151A_Y272A_C307A_L421Y_Y422G_T525S |
| 2280 | D149A_E151A_L421F_Y422A_P423G_T525S |
| 2281 | D149A_E151A_L421F_Y422G_T525S_S523A |
| 2282 | D149A_E151A_Y272A_C307V_L421F_Y422A_C520A_T525S |
| 2283 | D149A_E151A_L421Y_Y422G_A496L |

FIG. 145-2

Table 8: Wild type RMF 90817 = SEQ ID NO:2215

| SEQ# | Mutations based on SEQ ID NO:2215 |
|---|---|
| 2284 | Y11F_D149A_E151A_Y272A_C307A_L421F_Y422G_C520A_T525S |
| 2285 | D149A_E151A_C307A_L421F_Y422A_T525S |
| 2286 | D149A_E151A_L421F_Y422A_P423G_A496S |
| 2287 | Y11F_D149A_E151A_C307V_L421Y_Y422G_C520A_T525S |
| 2288 | D149A_E151A_Y272A_C307A_L421Y_Y422G_C520A_T525S |
| 2289 | D149A_E151A_L421F_Y422G_A496S |
| 2290 | D149A_E151A_L421F_Y422A_T525A |
| 2291 | D149A_E151A_L421Y_Y422G_A496V |
| 2292 | D149A_E151A_C307A_L421F_Y422A_C520A_T525S |
| 2293 | D149A_E151A_L421F_Y422G_T525S |
| 2294 | D149A_E151A_L421S_Y422A_P423A_T525A |
| 2295 | Y11F_D149A_E151A_L421F_Y422A_P423G |
| 2296 | D149A_E151A_L421Y_Y422A_A496L |
| 2297 | D149A_E151A_L421F_Y422A_P423G_A496T |
| 2298 | D149A_E151A_L421A_Y422A_A496T |
| 2299 | Y11F_D149A_E151A_L421Y_Y422A |
| 2300 | Y11F_D149A_E151A_Y272A_C307V_L421Y_Y422G_C520A_T525S |
| 2301 | D149A_E151A_L421F_Y422G_A496L |
| 2302 | D149A_E151A_L421S_Y422A_P423A_A496L |
| 2303 | D149A_E151A_L421A_Y422A_A496V |
| 2304 | D149A_E151A_C307A_L421F_Y422G_C520A_T525S |
| 2305 | D149A_E151A_C307V_L421F_Y422A_T525S |
| 2306 | D149A_E151A_L421A_Y422A_A496S |
| 2307 | Y11F_D149A_E151A_C307V_L421F_Y422G_C520A_T525S |

FIG. 145-3

Table 8: Wild type RMF 90817 = SEQ ID NO:2215

| SEQ# | Mutations based on SEQ ID NO:2215 |
|---|---|
| 2308 | D149A_E151A_L421S_Y422A_A496V |
| 2309 | D149A_E151A_L421F_Y422A_T525S_S523A |
| 2310 | Y11F_D149A_E151A_C307V_L421F_Y422G_T525S |
| 2311 | D149A_E151A_L421A_Y422A_P423G_A496L |
| 2312 | D149A_E151A_L421Y_Y422A_A496V |
| 2313 | D149A_E151A_L421S_Y422A_P423A_A496T |
| 2314 | Y11F_D149A_E151A_Y272A_C307V_L421F_Y422A_C520A_T525S |
| 2315 | D149A_E151A_Y272A_C307V_L421F_Y422G_C520A_T525S |
| 2316 | D149A_E151A_Y272A_L421Y_Y422G_T525S |
| 2317 | D149A_E151A_L421S_Y422A_P423A_A496V |
| 2318 | Y11F_D149A_E151A_Y272A_C307V_L421Y_Y422G_T525S |
| 2319 | D149A_E151A_C307V_L421Y_Y422G_C520A_T525S |
| 2320 | Y11F_D149A_E151A_C307A_L421Y_Y422G_C520A_T525S |
| 2321 | D149A_E151A_L421F_Y422A_A496T |
| 2322 | D149A_E151A_L421F_Y422A_P423G_T525S_S523A |
| 2323 | D149A_E151A_L421Y_Y422G_T525S_S523A |
| 2324 | D149A_E151A_L421F_Y422A_P423A_T525S |
| 2325 | D149A_E151A_Y272A_C307V_L421F_Y422A_T525S |
| 2326 | D149A_E151A_L421F_Y422A_A496V |
| 2327 | Y11F_D149A_E151A_C307V_L421F_Y422A_T525S |
| 2328 | D149A_E151A_L421Y_Y422A_A496S |
| 2329 | D149A_E151A_C307A_L421Y_Y422G_C520A_T525S |
| 2330 | D149A_E151A_L421Y_Y422A_T525S |

FIG. 145-4

Table 8: Wild type RMF 90817 = SEQ ID NO:2215

| SEQ# | Mutations based on SEQ ID NO:2215 |
|---|---|
| 2331 | Y11F_D149A_E151A_L421Y_Y422A_P423G |
| 2332 | D149A_E151A_L421F_Y422A_P423A_A496L |
| 2333 | Y11F_D149A_E151A_Y272A_C307V_L421F_Y422A_T525S |
| 2334 | Y11F_D149A_E151A_Y272A_C307A_L421F_Y422G_T525S |
| 2335 | D149A_E151A_L421S_Y422A_P423A_T525S |
| 2336 | Y11F_D149A_E151A_C307A_L421F_Y422A_T525S |
| 2337 | D149A_E151A_L421S_Y422A_A496L |
| 2338 | Y11F_D149A_E151A_L421F_Y422G |
| 2339 | D149A_E151A_C307A_L421F_Y422G_T525S |
| 2340 | Y11F_D149A_E151A_Y272A_C307A_L421Y_Y422G_C520A_T525S |
| 2341 | D149A_E151A_L421A_Y422A_P423G_T525S_S523A |
| 2342 | D149A_E151A_L421A_Y422A_P423G_A496T |
| 2343 | D149A_E151A_L421A_Y422A_P423G_A496S |
| 2344 | Y11F_D149A_E151A_Y272A_C307A_L421F_Y422A_C520A_T525S |
| 2345 | Y11F_D149A_E151A_Y272A_C307A_L421F_Y422A_T525S |
| 2346 | D149A_E151A_Y272A_C307A_L421F_Y422G_C520A_T525S |
| 2347 | Y11F_D149A_E151A_Y272A_L421Y_Y422G_T525S |
| 2348 | Y11F_D149A_E151A_C307V_L421Y_Y422G_T525S |
| 2349 | D149A_E151A_L421Y_Y422G_T525A |
| 2350 | D149A_E151A_L421F_Y422A_P423G_T525A |
| 2351 | D149A_E151A_L421A_Y422A_P423G_T525S |
| 2352 | D149A_E151A_L421F_Y422A_P423A_A496S |
| 2353 | Y11F_D149A_E151A_L421Y_Y422A |

FIG. 145-5

Table 8: Wild type RMF 90817 = SEQ ID NO:2215

| SEQ# | Mutations based on SEQ ID NO:2215 |
|---|---|
| 2354 | Y11F_D149A_E151A_L421A_Y422A_P423G |
| 2355 | Y11F_D149A_E151A_L421F_Y422A_P423A |
| 2356 | Y11F_D149A_E151A_C307A_L421F_Y422A_C520A_T525S |
| 2357 | D149A_E151A_L421F_Y422A_P423A_T525S_S523A |
| 2358 | D149A_E151A_Y272A_C307V_L421Y_Y422G_T525S |
| 2359 | D149A_E151A_C307A_L421Y_Y422G_T525S |
| 2360 | Y11F_D149A_E151A_Y272A_C307V_L421F_Y422G_C520A_T525S |
| 2361 | D149A_E151A_L421S_Y422A_T525S_S523A |
| 2362 | D149A_E151A_L421F_Y422A_A496L |
| 2363 | D149A_E151A_L421F_Y422A_P423A_A496T |
| 2364 | D149A_E151A_L421Y_Y422G_A496T |
| 2365 | Y11F_D149A_E151A_C307A_L421F_Y422G_T525S |
| 2366 | D149A_E151A_L421F_Y422A_A496S |

FIG. 145-6

Table 9: Wild type MBC 7218772 = SEQ ID NO:2367

| SEQ# | Mutations based on SEQ ID NO:2367 | Incorp'n |
|---|---|---|
| 2368 | D173A_E175A_L451F_Y452G | + |
| 2369 | D173A_E175A_L451F_Y452A_P453G | + |
| 2370 | D173A_E175A_L451S_Y452A_P453G | + |
| 2371 | D173A_E175A_L451S_Y452A | 0 |
| 2372 | D173A_E175A_L451S_Y452G_P453A | 0 |
| 2373 | D173A_E175A_L451Y_Y452G_P453A | 0 |
| 2374 | D173A_E175A_L451Y_Y452A_P453G | 0 |
| 2375 | D173A_E175A_L451F_Y452G_P453A | 0 |
| 2376 | D173A_E175A_L451A_Y452A_P453A | 0 |
| 2377 | D173A_E175A_L451S_Y452G | 0 |
| 2378 | D173A_E175A_L451A_Y452A_P453G | + |
| 2379 | D173A_E175A_L451A_Y452G | 0 |
| 2380 | D173A_E175A_L451A_Y452G_P453A | 0 |
| 2381 | D173A_E175A_L451Y_Y452A | + |
| 2382 | D173A_E175A_L451S_Y452A_P453A | + |
| 2383 | D173A_E175A_L451A_Y452A | + |
| 2384 | D173A_E175A_L451Y_Y452A_P453A | + |
| 2385 | D173A_E175A_L451Y_Y452G | 0 |
| 2386 | D173A_E175A_L451F_Y452A | 0 |
| 2387 | D173A_E175A_L451F_Y452A_P453A | + |

Table 10: Wild type MBC 7218772 = SEQ ID NO:2367

| SEQ# | Mutations based on SEQ ID NO:2367 |
|------|-----------------------------------|
| 2388 | D173A_E175A_L451Y_Y452A_T560S |
| 2389 | D173A_E175A_Y452A_C468A |
| 2390 | D173A_E175A_L451Y_Y452A_T560A |
| 2391 | D173A_E175A_L451Y_Y452A_T560S_S561A |
| 2392 | I10F_D173A_E175A_L451S_Y452A_P453A |

FIG. 147-1

Table 11: Wild type WP 175059460 = SEQ ID NO:2393

| SEQ# | Mutations based on SEQ ID NO:2393 |
|---|---|
| 2394 | D141A_E143A_Y412A |
| 2395 | D141A_E143A_I228V_L411A_Y412A_P413A_G441S_K443R_G710S_R712K_A770T |
| 2396 | D141A_E143A_I228V_L411S_Y412A_G441S_K443R_I524H_G710S_R712K_A770T |
| 2397 | D141A_E143A_I228V_L411A_Y412A_P413A_G441S_K443R_I524H_G710S_R712K_A770T |
| 2398 | D141A_E143A_I228V_L411S_Y412G_G441S_K443R_I524H_G710S_R712K_A770T |
| 2399 | D141A_E143A_I228V_L411S_Y412A_P413G_G441S_K443R_G710S_R712K_A770T |
| 2400 | D141A_E143A_I228V_L411S_Y412A_G441S_K443R_A488S_G710S_R712K_A770T |
| 2401 | D141A_E143A_I228V_L411S_Y412G_G441S_K443R_G710S_R712K_A770T |
| 2402 | D141A_E143A_I228V_L411A_Y412A_P413A_G441S_K443R_A488S_G710S_R712K_A770T |
| 2403 | D141A_E143A_I228V_L411S_Y412A_P413G_G441S_K443R_A488S_G710S_R712K_A770T |
| 2404 | D141A_E143A_I228V_L411S_Y412A_G441S_K443R_G710S_R712K_A770T |
| 2405 | D141A_E143A_I228V_L411S_Y412G_G441S_K443R_A488S_G710S_R712K_A770T |
| 2406 | D141A_E143A_I228V_L411S_Y412A_P413G_G441S_K443R_I524H_G710S_R712K_A770T |
| 2407 | D141A_E143A_I228V_L411S_Y412A_G441S_K443R_A488S_K510L_I524H_G710S_R712K_A770T |

FIG. 148-1

Table 11: Wild type WP 175059460 = SEQ ID NO:2393

| SEQ# | Mutations based on SEQ ID NO:2393 | Incorp'n |
|---|---|---|
| 2511 | D141A_E143A_L411A_Y412A_P413A | + + |
| 2512 | D141A_E143A_L411S_Y412A_P413G | + + |
| 2513 | D141A_E143A_L411S_Y412A | + + |
| 2514 | D141A_E143A_L411S_Y412G | + + |
| 2515 | D141A_E143A_L411A_Y412A_P413A_A488S | + + |
| 2516 | D141A_E143A_L411S_Y412A_P413G_A488S | + + + |
| 2517 | D141A_E143A_L411S_Y412A_A488S | + + + |
| 2518 | D141A_E143A_L411S_Y412G_A488S | + + |
| 2519 | D141A_E143A_L411A_Y412A_P413A_I524H | + |
| 2520 | D141A_E143A_L411S_Y412A_P413G_I524H | + |
| 2521 | D141A_E143A_L411S_Y412A_I524H | + + |
| 2522 | D141A_E143A_L411S_Y412G_I524H | + |
| 2523 | D141A_E143A_L411S_Y412A_A488S_K510L_I524H | + + + |

FIG. 148-2

Table 12: Wild type KUO 42443 = SEQ ID NO:2408

| SEQ# | Mutations based on SEQ ID NO:2408 | Incorp'n |
|---|---|---|
| 2409 | D170A_E172A_L448A_Y449A_P450G | 0 |
| 2410 | D170A_E172A_L448F_Y449A | + |
| 2411 | D170A_E172A_L448Y_Y449A | + |
| 2412 | D170A_E172A_L448Y_Y449A_P450G | + |
| 2413 | D170A_E172A_L448S_Y449G_P450A | 0 |
| 2414 | D170A_E172A_L448A_Y449G_P450A | 0 |
| 2415 | D170A_E172A_L448S_Y449G | 0 |
| 2416 | D170A_E172A_L448A_Y449A_P450A | 0 |
| 2417 | D170A_E172A_L448A_Y449G | 0 |
| 2418 | D170A_E172A_L448Y_Y449A_P450A | 0 |
| 2419 | D170A_E172A_L448F_Y449G | 0 |
| 2420 | D170A_E172A_L448F_Y449G_P450A | 0 |
| 2421 | D170A_E172A_L448F_Y449A_P450A | 0 |
| 2422 | D170A_E172A_L448F_Y449A_P450G | + |
| 2423 | D170A_E172A_L448Y_Y449G_P450A | 0 |
| 2424 | D170A_E172A_L448Y_Y449G | 0 |

FIG. 149-1

Table 13: Wild type KUO 42443 = SEQ ID NO:2408

| SEQ# | Mutations based on SEQ ID NO:2408 |
|---|---|
| 2425 | D170A_E172A_L448Y_Y449A_P450G_T557A |
| 2426 | D170A_E172A_L448S_Y449A_P450A |
| 2427 | Y7F_D170A_E172A_L448Y_Y449G_T557S |
| 2428 | D170A_E172A_L448S_Y449A_P450G |
| 2429 | D170A_E172A_Y449A |
| 2430 | Y7F_D170A_E172A_L448S_Y449A |
| 2431 | D170A_E172A_L448Y_Y449A_P450G_T557S |
| 2432 | D170A_E172A_L448S_Y449A |
| 2433 | D170A_E172A_L448Y_Y449G_T557S |
| 2434 | D170A_E172A_L448Y_Y449A_P450G_T557S_S558A |
| 2435 | D170A_E172A_L448A_Y449A |

FIG. 150-1

Table 14: Wild type NOZ 77387 = SEQ ID NO:2436

| SEQ# | Mutations based on SEQ ID NO:2436 |
|---|---|
| 2437 | Y10F_C41A_D161A_E163A_L432F_Y433A_P434G_C531A_T536S |
| 2438 | Y10F_C41A_D161A_E163A_L432Y_Y433A_C531A_T536S |
| 2439 | Y10F_C41A_D161A_E163A_L432F_Y433G_C531A_T536S |
| 2440 | C41A_D161A_E163A_L432F_Y433A_P434G_C531A_T536S |
| 2441 | Y10F_C41A_D161A_E163A_L432Y_Y433G_C531A_T536S |
| 2442 | Y10F_C41A_D161A_E163A_L432S_Y433A_C531A_T536S |
| 2443 | C41A_D161A_E163A_L432F_Y433A_C531A_T536S |
| 2444 | Y10F_C41A_D161A_E163A_L432Y_Y433G_C531A_T536S |
| 2445 | C41A_D161A_E163A_L432Y_Y433G_C531A_T536S |
| 2446 | C41A_D161A_E163A_L432Y_Y433A_C531A_T536S |
| 2447 | C41A_D161A_E163A_L432A_Y433A_P434A_C531A_T536S |
| 2448 | C41A_D161A_E163A_L432Y_Y433A_P434G_C531A_T536S |
| 2449 | Y10F_C41A_D161A_E163A_L432A_Y433A_P434A_C531A_T536S |
| 2450 | C41A_D161A_E163A_L432S_Y433A_C531A_T536S |
| 2451 | Y10F_C41A_D161A_E163A_L432Y_Y433A_P434G_C531A_T536S |
| 2452 | C41A_D161A_E163A_L432F_Y433G_C531A_T536S |
| 2453 | Y10F_C41A_D161A_E163A_L432F_Y433A_C531A_T536S |
| 2454 | Y10F_C41A_D161A_E163A_L432Y_Y433G_C531A_T536S |

FIG. 151-1

Table 15: Wild type Phi29 = SEQ ID NO:2455

| SEQ# | Mutations based on SEQ ID NO:2455 |
|---|---|
| 2456 | M97K |
| 2457 | M97R |
| 2458 | I93K |
| 2459 | I93R |
| 2460 | Y101K |
| 2461 | Y101R |
| 2462 | Q99K |
| 2463 | Q99R |
| 2464 | M102K |
| 2465 | M102R |
| 2466 | F128K |
| 2467 | F128R |
| 2468 | M188K |
| 2469 | M188R |
| 2470 | L195K |
| 2471 | L195R |
| 2472 | L253A |
| 2473 | L253S |
| 2474 | L253I |
| 2475 | L253F |
| 2476 | L253M |
| 2477 | Y254A |
| 2478 | Y254G |
| 2479 | Y254S |
| 2480 | P255S |
| 2481 | P255T |
| 2482 | P255A |
| 2483 | P255G |

FIG. 152-1

Table 15: Wild type Phi29 = SEQ ID NO:2455

| SEQ# | Mutations based on SEQ ID NO:2455 |
|---|---|
| 2484 | L416K |
| 2485 | L416R |
| 2486 | N396K |
| 2487 | N396R |
| 2488 | V425K |
| 2489 | V425R |
| 2490 | D535K |
| 2491 | D535R |
| 2492 | Y500N |
| 2493 | Y500K |
| 2494 | Y500R |
| 2495 | P558S |
| 2496 | P558T |
| 2497 | P558K |
| 2498 | L381S |
| 2499 | L381V |
| 2500 | L381G |
| 2501 | L381A |

FIG. 152-2

```
RLF89   ------------MILDTDYITENGKPVIRIFKKEKGEEKIEYDRNEEPYIYALLEDDESI-EDIK              52
WP175   ------------MILDTDYITKDGKPIIRIFKKENGEEKIELDPHFQPYIYALLKDDSAI-EEIK              52
MBC72   ------------MRGLLFDVDIAEEEERPNVRLFVKVASETVVAIDPQFEEYFYVVADHPAKTSKLIE           56
KUO42   ------------MLLDVDYAEEEEKPSIRLFVKTGSEVLVAIDPDFEEYFYVVSDHPAKASKLIE              53
NOZ58   MPRRILKGFLIDADYETVEGRALIRLFLRGEEGSFVVYDDSFSPYFYALPGDEPERVKE-R                  59
RMF90   ---MARDLLLDIDYTVDEKAQVRLFLKD------KILFDPGFQPYFYVLAHDGAVE-E---                  49
NOZ77   -------MDGFLLDVDYKTVDEKPVVRLFLRD-----VIALDPSFRPYVVVACDDPRAVAGEIK               52
                    :..  *   * : :*:.    .:  .* .*   *  .

RLF89   KITGERHGKKVRIITRVEKVKKFLGEPIEVWKLVFEHPQDVPAIRDAIRSHPAVREIFEY                    112
WP175   AIKGERHGKTVRVLDAVKVRKKFLGREVEVWKLIFEHPQDVPAMRDKIKEHPAVIDIYEY                   112
MBC72   KIELDEGGRPIRPKSVEMVRRTLLGNEVEAIRVSFHQPRDAAKLRHKIRELPGVKEIYEF                   116
KUO42   KVEVEEDGVSIRPKGVEIVKRTFLGNEVEAIKVSFYQAKDSSKLRHKIRELPGVREIYEF                   113
NOZ58   ILAS-----GAAEAIQKVEIEEKRLFGTPRVALRITVSHPQDVPRIRERIRRVEGVDLIIEH                 116
RMF90   -------RLRDEGAVEAVQRRMLGREMRFEKLISHPSEVPKIREEVRSIEGVEGIFEH                     101
NOZ77   DLEL----DGRRPVTGVEEMERGLLGRPRRFLKVYLGHPQQVPRVRDLLRRLPGSAVLED                   109
                .    :*  :.   :::                 *

RLF89   -------------------------------EELKLLAFDIET                                   144
WP175   -------------------------------EELKLLAFDIET                                   144
MBC72   ------------EELKLLAFDIET-EETRLNIMSFDIEV                                        176
KUO42   DIPPARRYLIDRGLTPMAGIEFSGSIEVRDGVKTVVMDGPPKPAPVEETRLNIMSFDIEV                   173
NOZ58   DILFVRRYLIDRGIKPLTWLRLEVEERDGRALLRGV-----EQLEEEPPELRVAAVDIEV                   171
RMF90   DILFARRYLIDKGLTPLNYAEYRAEQ------GFLKGI-------SSAGEGPESLRVMAFDIET               152
NOZ77   DILFSRRYLIDKGLVPTAWVELQGRVEGSEFWVEEV--------RRAEGPLPRLKVMSFDIET                164
        *. :                                              *.** .*.
```

FIG. 153-1

```
RLF89   FYHEGDEF-AEGEILMISYADESGA-KVITWKKI---DLPYVEVVSTEREAIKRFLQVLRE   200
WP175   FYHEGDEF-GKGEIIMISYADEEEA-RVITWKNI---DLPYVDVVSNEREMIKRFVQVVKE   200
MBC72   YNPTGSVRPDKDPTIMISLADNRGLRKVITWKNFDKKPEYVEVVGSEREMIKKFVELVKE   236
KUO42   YNPTGSVRPDKDPIIMISLADNNGLRKVITWKNFERSQEYVEVVGSEREMIKRFVDLVKE   233
NOZ58   YNPKGAPRSSKDEIIMISVATSDGVEKVLTWRE-VQGLEQVEVLQDEKEMLLRFAELIKE   230
RMF90   YNPKGAPRAEKDPVIMLSLSTNTGLRRLLTYKS-GEGLDFVELVEDEKALLHRFKELVNE   211
NOZ77   YNPKGAPRGDQDPIIMVSMATSGGLRKVLSWKAPTAGLEFVETLEDEAAVLRRFEELVRQ   224
         :   :      *    ::   .    *       .     :  :  ::  :::. .

RLF89   KDPDVLLTYNGDNEFDFAYIKKRCEKLGLKFTIGRDG--SEPKIQRMGDRFAVEVKGRIHL   258
WP175   KDPDVIITYNGDNFDLPYIKKRCEKLGLKFTIGRDG--SEPKIQRMGDRFAVEIKGRIHF   260
MBC72   RDVDILLGYNTDLFDLPYIRSRAKQLRVKLDLGRDG--SELVVRKRRFATASKIRGRVHV   294
KUO42   RDVDILLGYNTDLFDLPYIRSRAKQLRVKLDLGRDG--SELVVRKRRFATASKIRGRIHV   291
NOZ58   GDYDIVGYNTDSFDFPYIRDRLKKLGISLPLGRLD---AELEVSRRGALPEARIRGRAHV   288
RMF90   EGVEVLVGYNSDQFDLPYLVARAKALGVELPLGQDG--SQPIRKGRGLVESVVKGRPHV   269
NOZ77   EDPDLLVGYNTDNFDFPYLNQRLRKALGIELALGRDG--SPHKTSTRMGMSETRMAGRPHM   282
        . * :  ** *:.* **: :   : ::   * .    *      :   :   :    .

RLF89   DLYPVVR------HTIRLPTYTLEAVYEAVFGKKKEKVYAEEIAEAWKSE-EGLKRVAQYS   312
WP175   DLFPVVR------RTINLPTYTLEAVYEAVLGKTKSKLGAEEIAAIWETE-ESMKKLAQYS   314
MBC72   DVFAMVDFLATIGSIRLIHYSLADVYRHYAGREKPDFEFSEMINAWERGGDAGRRFLEYS   354
KUO42   DVFAMVDFLATIGSIKLIHYSLADVYRHLLGKEKPDFEFTEMVDAWEKGGDAGRKFLEYS   351
NOZ58   DLYPIVR------RHVKLNSYVLESVVEELLGISKKEVLGREKEKIPHDAMCGYWRDGELFTYWDEGGEKRALLARYA   343
RMF90   DLYPIVR------RNVRLSSYVLENVVKEVLGENVVKEVLGREKEKIPHDAMCGYWDRGGRELIQRFMAYS   324
NOZ77   DLYPIVR------RSLRLPSVVLEDVVAEVLGEEKEKVPGERMGEIWDKGGEELDRFFRYS   337
                   : *  . :*: *      *          :   .            .

FIG. 153-2
```

```
RLF89  MEDARATYELGREFFPMEVELAKLIGQSVWDVSRSSTGNLVEWYLLRVAYERNELAPNKP    372
WP175  MEDARATYELGKEFFPMEAELAKLIGQSVWDVSRSSTGNLVEWYLLRVAYARNELAPNKP    374
MBC72  MSDADATLEVGSELLPLIFLGLTRVVGQTLFDVQRMTPGQLVEWLLVAEAHRIGELVPPRP    414
KUO42  MSDADATLEVGLELLPLIFLGLTRVVGQTLFDVQRMTPGQLVEWLLVAEAHRIGELVPGRP    411
NOZ58  LEDARVTLALAEKFLPLYCELSTTVGQSLNDVARMTSGQLVEWLLMRYATPRGELIPNHP    403
RMF90  MEDADVTLELAERFLPLYIELSRVVGLPLHDVARMTAGQLVEWLLIREAFARGEVVPNKG    384
NOZ77  LEDAEVTLRIGEKYLPLYIELSRLVGQSIHDVARMTAGQLVEWYLMREAFARGEVIPERP   397
       : :*   :  ::     *  ::  *   :*:    **:****:*: .   *. :

RLF89  GGEEYQRRMRSSYIGGYVKEPEKGLWESIAYLDFRSLYPSIIVTHNVSPDTLEK-ECKN-   430
WP175  DEEEYKRRLRTTYLGGYVKEPEKGLWENITYLDFRSLYPSIIVTHNVSPDTLEKEGCEN-  433
MBC72  VGEEFEERAEGTFTGAYVMEPVKGLHEDLVVFDFRSLYPSIIVTHNIDPSTLNCRDCKPG  474
KUO42  VGEEYEERMEETFVGAYVMEPVKGLHENLVVFDFRSLYPSIIVTHNIDPSTLNCKDCKPG  471
NOZ58  AGEEYAARARATYAGGYVREPKRGLVEHIAVFDFRSLYPSIIVSHNIDPSTLIVGNCE--  461
RMF90  SGREYLARSEDTYAGGYVMEPVKGIVENIVVFDFRSLYPSIIVTHNIDPATLRPGR-G--  441
NOZ77  GGREFARRAGDTYEGGYVREPRKGLLEK---VFDFRSLYPSIVTHNIDPSTIRPGP-G--  452
            :  :  *.***:*: ::*: : :  **********:*:**:**::

RLF89  -YDVAPIVGYRFCKDFKGFIPSILEDLIETRQKVKRKMKAT-IDPIEKKMLDYRQRALKI  488
WP175  -YDIAPIVGYKFCKDFPGFIPSILGDLIAMRQEIKKKMKAT-IDPIEKKMLDYRQRAVKL  491
MBC72  EREQVPGLSYYFCKRRKGFIPAVLERVIEERTKLKAELKKIGRETREYRALDARQWAMKI  534
KUO42  EREQVPGLEYYFCRRRKGFIPATLQRIIEERMKLKAELKKKLVRGTKEYRALDARQWAMKI 531
NOZ58  -ENRAPELEYCFSLEREGFIPAILKELIRRRAEIKRELKRS-EG-DRRRTLSFAEKALKI  518
RMF90  -ENSPPELDYHFTTEEEGFIPSVLKRVLERRLSAKRRMKEA-RDPGEKRMLDISQRALKI  499
NOZ77  -ENQPPGIDYHFTTEKEGFIPALLKRLVARRAELKEEMKKA-RDPGERKMLDVQQQALKI  510
         :  . ::   .: *** :*: ::                     :: :  *:*

FIG. 153-3
```

```
RLF89    LANSYYGYQGYPKARWYSKECAESVTAMGRHYIETTIKEA-EKFGFKVLYADTDGFFATI    547
WP175    LANSYYGYMGYPKARWYSKECAESVTAMGRHYIEMTIKEIEEKFGFKVLYADTDGFYATI    551
MBC72    VANSFYGMLGYPRARWYSKQCAESVTSFGRHYIHRTIEMA-REFGLEVVYGDTDSLHCKL    593
KUO42    VANSFYGMLGYPRARWYSKECAESVTSFGRHYIHKTIDMA-REFGLEVVYGDTDSLHCKL    590
NOZ58    LANSFYGMGYPRARWYRRECAESVAAFARMYIKQVMRIAEEEFKLEVVYGDTDSLFVVI    578
RMF90    IANSFYGYMGYPRARWYKKECAESVTSFARMYTKKVMAIAEEEYGFKVVYGDTDSLFIVV    559
NOZ77    LANSFYGYMGYPRARWYRKECAESVTAFARDYIKKVMEVAEKEFGLEVVYGDTDSLFILV    570
         :***:**  ** :**** : ****.:* * * .   .    :. *::*****.*: :

RLF89    PNEKPETIKSKAKKFLKHINEKLPGMLELEYEGFYLRGFFVTKKKYALIDEDGHITTRGL    607
WP175    PGEKPEIIKKKAREFLNYINSKLPGLLELEYEGFYLRGFFVTKKRYAVIDEEGRITTRGL    611
MBC72    NGKTRE----EAMVFLRKVNESLPGIMELELEGFYPRGIFITKKRYAMDDEGRMVVKGL    649
KUO42    NGKTRE----EALAFLKKVNDSLPGIMELELEGFYPRGIFITKKRYAMIDDEGRMVVKGL    646
NOZ58    PPEKRE----LAQKFLQRKVNESMPGIIELEFEGFVELEYDGFYPRGIFITKKRYALLSEDGRMVVKGL    634
RMF90    QPEEKE----RAMSFMEDVNRRLPGTVELEYDGFYPRGIFITKKRYALIDEKGNIVVKGL    615
NOZ77    PGGKKE----RAFAFLEEVNRRLPGTIELEYEGFYRRGIFVTKKRYALIDEKDRIIVKGL    626
            .    .*  *   :: .* * :** ::** .*: **:*:***:*:..  : :*.

RLF89    EVVRRDWSEIAKETQAKVLEVILREGSIEKAAGIVKKVVEDLANYRVPVEKLIIHEQITR    667
WP175    EVVRRDWSEIAKETQAKVLEAILKDGSVEKAVEIVRDVVEKIAKYRVPLEKLVIHEQITR    671
MBC72    EFVRRDWAAIAKKTQEEVLRAILRDGSPKKAAEIIRKTTRDVYEGRVNLEDLIIYTQLKM    709
KUO42    EFVRRDWAAIAKKTQEEVLKAILKDGSPEKAAEIIRKTTRDVYEGRVNLEDLIIYTQLKM    706
NOZ58    EFVRRDWAPIARETQKEVLRILLEEADPEKAARLVRDVIERTRQRRVSLEDITIYTQLTK    694
RMF90    ETVRRDWTRLSRDTQQKVLSVILREGDPKKAADIVKDTINRLKERRVDLEDITITYQLTK    675
NOZ77    EFVRRDWAPIARDTQEKVLKALLKDASPEEAVRIVRKAMDDIRARRVSLEDLTIYTQLTK    686
         * ****   :::.**.:** ::     :.*    :..   .   .: :*:: * :*:
```

FIG. 153-4

```
RLF89  ELKDYKATGPHVAIAKRLQARGIKVKPGTIISYVLKGSKKISDRVILEDEYDSSRHKYD  727
WP175  DLKDYKAIGPHVSIAKRLATRGIKVKPGTIISYLVLKGGGRISDRVILLTEYDPEKHKYD  731
MBC72  PIESYKAIGPHVVAAKRLRELGHEIEPGMMIAYIEVKGPGSISDRAVPVEDF---EGKEYD  767
KUO42  PIESYKAIGPHVVAAKRLRELGHEIEPGMMIAYVEVKGPGSISERAVPVEDF---KGREYD  764
NOZ58  RIKSYKSLEPHVVAAQKLKERGREVAPGMIIGYIITKGTKGISQRATPVEFA--RLEDYD  752
RMF90  GIGRYKNVGPHVKAAQKAIDRGREVNPGMAIGYIIKKGRGLISDRAEPVEDA--TIEDYD  733
NOZ77  K----------------------------------------------------------  687

RLF89  PDYYIHNQVLPAVLRILEAFGYKEKDLEYQRMKQTGLGAWLKMGKK----  773
WP175  PDYYIENQVLPAVLRILEAFGYRKEDLRYQSSKQTGLDAWLKR------  774
MBC72  PDYYVGHQILPAVMRIMEVLGYSEEDLKFEREKQIGLDRFMK-------  809
KUO42  PDYYVGHQVLPAVMRIMEVLGYREIDLKFERQRQVGLDRFMK-------  806
NOZ58  PEYYIDNQILPAIQRIFEAIGYTRDYLKEGI-TQTSLSRWF--------  792
RMF90  VDYYIENQVLPPVARIMEVLGYSKEHLKEEM--VQGSLQRWF-------  773
NOZ77  ---------------------------------------------  687
```

FIG. 153-5

```
Bst       MKKKLVLIDGNSVAYRAFFALPLLHNDKGIHTNAVYGFTMMLNKILAEEQPTHLLVAFDA   60
RLF89     ---------------------------------------MILDTDYITENGKPVIRIFKK   21
90N       ---------------------------------------MILDTDYITENGKPVIRVFKK   21
Pfu       ---------------------------------------MILDVDYITEEGKPVIRLFKK   21
Pabyssi   ---------------------------------------MIIDADYITEDGKPIIRIFKK   21
                                                 *:  *:   :*:* ::*:**

Bst       GKTTFRHETFQEYKGGRQQTPPELSEQFPLLRELLKAYRIPAYELDHYEADDIIGTLAAR  120
RLF89     EKGEFKIEYD--------------------------------------------------  31
90N       ENGEFKIEYD--------------------------------------------------  31
Pfu       ENGKFKIEHD--------------------------------------------------  31
Pabyssi   EKGEFKVEYD--------------------------------------------------  31
            *.**: *

Bst       AEQEGFEVKIISGDRDLTQLASRHVTVDITKKGITDIEPYTPETVREKYGLTPEQIVDLK  180
RLF89     ----------------------------------RNFEPYIYALLEDD------ESIEDIK   52
90N       ----------------------------------RTFEPYFYALLKDD------SAIEDVK   52
Pfu       ----------------------------------RTFRPYIYALLRDD------SKIEEVK   52
Pabyssi   ----------------------------------RTFRPYIYALLKDD------SAIDEVK   52
                                            . :.* *  :   *  : :*:*

Bst       GLMGDKSDNIPGVPGIGEKTAVKLLKQFGTVENVLASI--DEVKGEKLKENLRQHRDLAL  238
RLF89     KITGERHGKKVRIIRVEK-VKKKFL---GEPIEVWKLVFEHPQDVPAIRDAIRSHPAVR-  107
90N       KVTAKRHGTVVKRAEK---VQKKFL---GRPIEVWKLYFNHPQDVPAIRDRIRAHPAVV-  107
Pfu       KITGERHGKIVRIVDVEK-VEKKFL---GKPITVWKLYLEHPQDVPTIREKVREHPAVV-  107
Pabyssi   KITAERHGKIVRITEVEK-VQKKFL---GRPIEVWKLYLEHPQDVPAIREKIREHPAVV-  107
          : *  : ::   :     *:::*    *.**.***  :.    :*   :  * .
```

FIG. 154-1

```
Bst      LSKQLASICRDAPVELSLDDIVYEGQDREKVTALEKELGFQSFLEKMAAPAAEGEKPLEE        298
RLF89    -------------------EIFEYDIPF--------------A-KRYLIDKGLVPMEGGEEIKL        137
9oN      -------------------DIYEYDIPF--------------A-KRYLIDKGLIPAEGDEELTM        137
Pfu      -------------------DIFEYDIPF--------------A-KRYLIDKGLIPMEGEEELKI        137
Pabyssi  -------------------DIFEYDIPF--------------A-KRYLIDKGLTPMEGNEELTF        137
                            :*****                  * *******:* *  **::

Bst      MEFAIVDVITEEMLADKAALVVEVMEENYHDAPIVGIALVNEHGRFFMRPETALADSQFL        358
RLF89    LAFDIETFYHE---------------------GDEFAEGEILMISYADESG---------AKVI    171
9oN      LAFDIETLYHE---------------------GEEFGTGPILMISYADGSE---------ARVI    171
Pfu      LAFDIETLYHE---------------------GEEFGKGPIIMISYADENE---------AKVI    171
Pabyssi  LAVDIETLYHE---------------------GEEFGKGPIIMISYADEEG---------AKVI    171
         : *                             .:* *  *:*****: .          ::.:

Bst      AMLADETKKKSMFD------------AKRAVVALKWKGIELRGVAFDLLLAAYLLNPA            404
RLF89    TWKKIDLPYVEVVSTEREAIKRFLQVLREKDPDVLLTYN-------GDNFDF----AYIKKRC    223
9oN      TWKKIDLPYVDVVSTEKEMIKRFLRVREKDPDVLITYN--------GDNFDF----AYLKKRC    223
Pfu      TWKNIDLPYVEVVSSEREMIKRFLRIIREKDPDIIVTYN-------GDSFDF----PYLAKRA    223
Pabyssi  TWKSIDLPYVEVVSSEREMIKRLVKVIREKDPDVIITYN-------GDNFDF----PYLLKRA    223
          *  .                                          **::*    *:  .

Bst      QD---------AGDIAA---------------VAKMKQYEAVRSDEAVY                    429
RLF89    EKLGLKFTIGRDGSEPKIQRMGDRFAVEVKGRIHLDLYPVVRHTIRLPTYTLEAVYEAVF        283
9oN      EELGIKFTLGRDGSEPKIQRMGDRFAVEVKGRIHFDLYPVIRRTINLPTYTLEAVYEAVF        283
Pfu      ERLGIKLTIGRDGSEPKMQRIGDMTAVEVKGRIHFDLYHVITRTINLPTYTLEAVYEAIF        283
Pabyssi  EKLGIKLPLGRDNSEPKMQRMGDSLAVEIKGRIHFDLFPVIRRTINLPTYTLEAVYEAIF        283
         :          *  *                       ***:::
```

FIG. 154-2

```
Bst       GKGVKRSLPDEQTLAEHLIVRKAAAIWALEQPFMDDLRNNEQDLLTKLEQPLAAILAEME  489
RLF89     GKKKEKVYAEE-------------IAEAWKSEEGLKRVAQYSMED--------------  315
9oN       GKPKEKVYAEE-------------IAQAWESGEGLERVARYSMED--------------  315
Pfu       GKPKERVYADE-------------IAKAWESGENLERVAKYSMED--------------  315
Pabyssi   GKSKEKVYAHE-------------IAEAWETGKGLERVAKYSMED--------------  315
          ** :  :*::              :*  **.   **:***:***

Bst       FTGVNVDTKRLEQMGSELAEQLRAIEQRIYELAGQEFNINSPKQLGVILFEKLQLPVLKK  549
RLF89     --------AR------ATYELGREFFPMEVELAKLIGQSVWDVSRSSTGNLV--EWY--LLR-  359
9oN       --------AK------VTYELGREFFPMEAQLSRLIGQSLWDVSRSSTGNLV--EWF--LLR-  359
Pfu       --------AK------ATYELGKEFLPMEIQLSRLVGQPLMDVSRSSTGNLV--EWF--LLR-  359
Pabyssi   --------AK------VTFELGKEFFPMEAQLARLVGQPVWDVSRSSTGNLV--EWF--LLR-  359
                   *       .*:**:** **.: :: *:.*  :****:****    :    :

Bst       TKTGYSTSADVLEKLAPHHEIVENILHYRQLGKLQSTYIEGLLKVVRPDTGKVHTMFNQ-  608
RLF89     --VAYE------RNELAPNKPGGE-------EYQRRMRSSYIGGYVKE--PEKGLWESIAYLD  405
9oN       --KAYK------RNELAPNKPDER-------ELARR-RGGYAGGVKE--PERGLWDNIVYLD  404
Pfu       --KAYE------RNEVAPNKPSEE-------EYQRRLRESYTGGFVKE--PEKGLWENIVYLD  405
Pabyssi   --KAYE------RNELAPNKPDER-------EYERRLRESYEGGYVKE--PEKGLWEGIVSLD  405
            . *       ::.:**::        *  :: :.*. *.: :   **:***. :  **

Bst       ------ALTQTGRLSSAEP---NLQNIPTRLEEGRKIRQ----AFVPSEPDWL--------  648
RLF89     FRSLYPSIIVTHNVSPDTLEK-ECKNYDVAPIVGYRFCKDFKGFTPSILEDLIETROKVK  464
9oN       FRSLYPSIITTHNVSPDTLNREGCKEYDVAPEVGHKFCKDEPGFTPSLLGDLLEERQKIK  464
Pfu       FRALYPSIITTHNVSPDTLNLEGCKNYDIAPQVGHKFCKDIPGFTPSLLGHLLEERQKIK  465
Pabyssi   FRSLYPSIITTHNVSPDTLNRENCKEYDVAPQVGHRFCKDPPGFTPSLLGNLLEERQKIK  465
                       .:*              :   :         **:  .       *
```

```
Bst       ------------KVDYHYGPTWYDAK--------------------------------------         876
RLF89     HEQITRELKDYKATGPHVAIAKRLQARGIKVKPGTIISYVVLKGSKKISDRVILEDEYDS              721
9oN       HEQITRDLRDYKATGPHVAVAKRLAARGVKIRPGTVISYIVLKGSGRIGDRAIPADEFDP              722
Pfu       YEQITRPLHEYKAIGPHVAVKKLAAKGVKIKPGMVIGYIVLRGDGPISNRAILAEEYDP               723
Pabyssi   YEQITRPLSEYKAIGPHVAVAKRLAAKGVKVKPGMVTGYIVLRGDGPISKRATAIEEFDP             722
                                  * *      **

Bst       --------------------------------------------------------               876
RLF89     SRHKYDPDYYIHNQVLPAVLRILEAFGYKEKDLEYQRMKQTGLGAWLKMGKK-                   773
9oN       TKHRYDAEYYIENQVLPAVLRILEGFGYKREDLRYQKTKQVGLGAWLKVKGKK                   775
Pfu       KKHKYDAEYYIENQVLPAVLRILEGFGYREDLRYQKTRQVGLTSWLNIRKS-                    775
Pabyssi   KKHKYDAEYYIENQVLPAVERILRAFGYRKEDLKYQKTKQVGLGAWLKF----                   771
```

FIG. 154-5

```
Bst       MKKKLVLIDGNSVAYRAFFALPLLHNDKGIHTNAVYGFTMMLNKILAEEQPTHLLVAFDA    60
NOZ58     -------------------------------MPRILKGFLIDADYETVEGR--ALIRLFLR    28
9oN       --------------------------------------MILDTDYITENGK---PVIRVFKK    21
Pfu       --------------------------------------MILDVDYITEEGK---PVIRLFKK    21
Pabyssi   --------------------------------------MIIDADYITEDGK---PIIRIFKK    21
                                                 :: ..*  :.  :  ** :*:

Bst       GKTTFRH---ETFQEYKGGRQQTPPELSEQFPLLRELLKAYRIPAYELDHYEADDIIGTL   117
NOZ58     GEEGSFVVYDDSFSPYF-------------------------YALP--------------    49
9oN       ENGEFKIEYDRTFEPYF-------------------------YALL--------------    42
Pfu       ENGKFKIEHDRTFRPYI-------------------------YALL--------------    42
Pabyssi   EKGEFKVEYDRTFRPYI-------------------------YALL--------------    42
           :  . :  *  .  *                         **

Bst       AARAEQEGFEVKIISGDRDLTQLASRHVTVDITKKGITDIEPYTPETVREKYGLTPEQIV   177
NOZ58     ---GDEPERVKERIL----ASGAAEAIQ---KVEIEEKRLF-----GTPRVALRITVSHPQDVP    98
9oN       --KDDSAIEDVKKVTAKRHGTVVKVK--RAEKVQKKFL------GRPIEVWKLYFNHPQDVP    94
Pfu       --RDDSKIEEVKKITGERHGKIVRIV--DVEKVEKKFL------GKPITVWKLYLEHPQDVP    94
Pabyssi   --KDDSAIDEVKKITAERHGKIVRIT--EVEKVQKKFL------GRPIEVWKLYLEHPQDVP    94
            . . :  :.: .    .   :    :   :::*:*        ..* .  :   .

Bst       DLKGLMGDKSDNIPGVPGIGEKTAVKLLKQF------G---TVENVLASIDEVKGEKLKENLR   231
NOZ58     RI-----RERIRRVEGVDLILEHDI-LFVRRYLIDRGIKPLTWLRLEVEERDGRALLRGVE   153
9oN       AI-----RDRIRAHPAVVDIYEYDI-PFAKRYLIDKGLIPAEG-----------------   131
Pfu       TI-----REKVREHPAVVDIFEYDI-PFAKRYLIDKGLIPMEG-----------------   131
Pabyssi   AI-----REKIREHPAVVDIFEYDI-PFAKRYLIDKGLTPMEG-----------------   131
                 .:  :   .. *: : .  *.: ** **.*            *
```

FIG. 155-1

```
Bst       QHRDLALLSKQLASICRDAPVELSLDDIVYEGQDREKVIALFKELGFQSFLEKMAAPAAE    291
NOZ58     QL----------------EEEPP------------------------------------    160
9oN       ---------------------DE-------------------------------------    133
Pfu       ---------------------EE-------------------------------------    133
Pabyssi   ---------------------NE-------------------------------------    133

Bst       GEKPLEEMEMEFAIVDVITEEMLADKAALVVEVMEENYHDAPIVGIALVNEHGRFFMRPETA    351
NOZ58     -------ELRVAAVDIEV------------YNPKGAPRSSKDEIIMISVATSDGVEKVLTWRE    204
9oN       -------ELTMLAFDIET------------LYHEGEE-FGTGPILMISYADGS-EARVITWKK    175
Pfu       -------ELKILAFDIET------------LYHEGEE-FGKGPIIMISYADEN-EAKVITWKN    175
Pabyssi   -------ELTFLAVDIET------------LYHEGEE-FGKGPIIMISYADEE-GAKVITWKS    175
                  *:  : ..::  *.               * :.

Bst       LADSQFLAWLADETKKKSMFDA--------KRAVVALKWKGIELRGVAFDLLLAAYLLNPA    404
NOZ58     VQGLEQVEVLQDE-----KEMLLRFAELIKEGDYDVIVG------YNTDSFDF----PYIRDRL    253
9oN       I-DLPYVDVVSTE-----KEMIKRFLRVVREKDPDVLIT------YNGDNFDF----AYLKKRC    223
Pfu       I-DLPYVEVVSSE-----REMIKRFLRIIREKDPDIIVT------YNGDSFDF----PYLAKRA    223
Pabyssi   I-DLPYVEVVSSE-----REMIKRLVKVIREKDPDVIIT------YNGDNFDF----PYLLKRA    223
          :  :    :     :: .*    :        *:*:       *:

Bst       QD-----------AGDIAA-------------------VAKMQYEAVRSDEAVY    429
NOZ58     KKLGISLPLGRLDAELEVSRRGALPEARIRGRAHVDLYPIVRRHVKLNSYVLESVVEELL    313
9oN       EELGIKFTLGRDGSEPKIQRMGDRFAVEVKGRIHFDLYPVIRRTINLPTYTLEAVYEAVF    283
Pfu       EKLGIKLTIGRDGSEPKMQRIGDMTAVEVKGRIHFDLYHVITRTINLPTYTLEAVYEAIF    283
Pabyssi   EKLGIKLPLGRDNSEPKMQRMGDSLAVEIKGRIHFDLFPVIRRTINLPTYTLEAVYEAIF    283
          ::                *            ::     *      *    *:
```

FIG. 155-2

```
Bst      GKGVKRSLPDEQTLAEHLVRKAAAIWALEQPFMDDLRNNEQDQLLTKLEQPLAAILAEME   489
NOZ58    GIKKEKLDGE--------------RLFTYWDEGGEKRALL-------AR----------YA   343
9oN      GKPKEKVYAE---------------ELAQAWESGE-GLERV------AR----------YS   312
Pfu      GKPKEKVYAD---------------EIAKAWESGE-NLERV------AK----------YS   312
Pabyssi  GKSKEKVYAH---------------EIAEAWETGK-GLERV------AK----------YS   312
          *  .   ::                  : .  .. :  *                     .:

Bst      FTGVNVDTKRLEQMGSELAEQLRAIEQRTYELAGQEFNINSPKQLGVILFEKLQLPVLKK   549
NOZ58    LED---------------ARVTLALAEKFLPLYCELSTIVGQSLNDVARMTSGQLV----   384
9oN      MED---------------AKVTYELGREFFPMEAQLSRLIGQSLWDVSRSSTGNLV----   353
Pfu      MED---------------AKATYELGKEFLPMEIQLSRLVGQPLWDVSRSSTGNLV----   353
Pabyssi  MED---------------AKVTFELGKEFFPMEAQLARLVGQPVWDVSRSSTGNLV----   353
          :                 *  .    ::   : . *   . :: . *   : :

Bst      TKTGYSTSADVLEKLAPHHEIVENILHYRQ--LGKLQSTYIEGLLKVVRPDTGKVHTMFNQ   608
NOZ58    --------EWLLMRYATPRGELIPNHPAGEEYAARARATYAGGYVRE--PKRGLVEHIAVF   435
9oN      --------EWFLLRKAYKRNELAPNKPDERELARR-RGGYAGGYVKE--PERGLWDNIVYL   403
Pfu      --------EWFLLRKAYERNEVAPNKPSEEEYQRRLRESYTGGFVKE--PEKGLWENIVYL   404
Pabyssi  --------EWFLLRKAYERNELAPNKPDEREYERRLRESYEGGYVKE--PEKGLWEGIVSL   404
                  .     . :  :  .        *       :       . *:

Bst      A-------LTQTGRLSSA------------------EPNLQ-----RLEEGRKI         636
NOZ58    DFRSLYPSIIVSHNIDPSTLIVGNCEEN-RAPELEYCFSLEREGFIPAILKELIRRRAEI   494
9oN      DFRSLYPSIITHNVSPDTLNREGCKEYDVAPEVGHKFCKDFPGFIPSLLGDLLEERQKI   463
Pfu      DFRALYPSIITHNVSPDTLNLEGCKNYDIAPQVGHKFCKDIPGFIPSLLGHLLEERQKI   464
Pabyssi  DFRSLYPSIITHNVSPDTLNRENCKEYDVAPQVGHRFCKDFPGFIPSLLGNLLEERQKI   464
          **:   * *:               :            *    *: * .  ::

FIG. 155-3
```

```
Bst      RQAFVPSEPDWLIFAADYSQIELRVLAHIADDNLIEAFQRDLDIHTKTAMDIFHVSEEE         696
NOZ58    KRELKRSEGD-RRRTLSFAEKALKILANSFYGY----MGYPRARWYRRECAESVAAFARMY       550
9oN      KRKMKATVDPLEKKLLDYRQRAIKILANSFYGY----YGYAKARWYCKECAESVTAWGREY       520
Pfu      KTKMKETQDPIEKILLDYRQKAIKLLANSFYGY----YGYAKARWYCKECAESVTAWGRKY       521
Pabyssi  KKRMKESKDPVEKKLLDYRQRAIKILANSYYGY----YGYAKARWYCKECAESVTAWGRQY       521
         ..  :   *  : :   :::*:    *     .:   ..  ::

Bst      VTANMRRQAKAVNFGIVYGISDYGLAQN----LNITRKEAAEFIERYFASFPGVKQYMEN        752
NOZ58    IKQVMRIAEEEFKLEVVYGDTDSLFVVIPPEKRE----LAQKFLQKVNESMPGIIELEFE        606
9oN      IEMVIRELEEKFGFKVLYADTDGLHATIPGADAETVKKKAKEFLKYINPKLPGLLELEYE        580
Pfu      IELVWKELEEKFGFKVLYIDTDGLYATIPGGESEEIKKKALEFVKYINSKLPGLLELEYE        581
Pabyssi  IDLVRRELE-SRGFKVLYIDTDGLYATIPGAKHEEIEKALKFVEYINSKLPGLLELEYE         580
         *:*   *   :  :  ***:    ** *

Bst      IVQEAKQKGYVTTLLHRRRYLPDITSRNFNVRSFAERTAMNTPIQGSAADIIKKAMIDLA       812
NOZ58    ---GFYRRGLF----VTKKRYALLSEDGKMV---------VKGLEFVRRDWAPIA           645
9oN      ---GFYVRGFF----VTKKKYAVIDEEGKIT---------TRGLEIVRRDWSEIA           619
Pfu      ---GFYKRGFF----VTKKKRYAVIDEEGKVI--------TRGLEIVRRDWSEIA           620
Pabyssi  ---GFYARGFF----VTKKKYALIDEEGKIV---------TRGLEIVRRDWSEIA           619
            ***  *:    ***: :*: : ::  :      ::  ** ::*

Bst      ARLKEEQLQARLLLQVHDELILEAPKEEIERLCELVPEVMEQAVTLRVPL-----            862
NOZ58    RET------QKEVLR----ILLEE---ADPEKAARLVRDVIERIRQRRVSLEDITIYTQLT     693
9oN      KET------QARVLE----AILKH---GDVEEAVRIVKEVTEKLSKYEVPPEKLVIHEQIT     667
Pfu      KET------QARVLE----TILKH---GDVEEAVRIVKEVIQKLANYEIPPEKLAIYEQIT     668
Pabyssi  KET------QAKVLE----AILKH---GNVDEAVKIVKEVTEKLSKYEIPPEKLVIYEQIT     667
         .        * .:*         .                          ::  ::
```

FIG. 155-4

```
Bst       ----KVDYHYGPTWYDAK---------------------------------------------  876
NOZ58     KRIKSYKSLEPHVVAAQKLKERGREVAPGMIIGYIITKGTKGISQRATPVEF---ARLEDY    751
9oN       RDLRDYKATGPHVAVAKRLAARGVKIRPGTVISYIVLKGSGRIGDRAIPADEFDPTKHRY     727
Pfu       RPLHEYKAIGPHVAVAKKLAAKGVKIKPGMVIGYIVLRGDGPISNRAILAEEYDPKKHKY     728
Pabyssi   RPLSEYKAIGPHVAVAKRLAAKGVKVKPGMVIGYIVLRGDGPISKRAIAIEEFDPKKHKY     727
                *:      *   *

Bst       ------------------------------------------------------------     876
NOZ58     DPEYYIDNQILPAIQRIFEAIGYTRDYLKEG-ITQTSLSRWF------------------     792
9oN       DAEYYIENQVLPAVERILKAFGYRKEDLRYQKTKQVGLGAWLKVKGKK------------     775
Pfu       DAEYYIENQVLPAVLRILEGFGYRKEDLRYQKTRQVGLTSWLNIKKS-------------     775
Pabyssi   DAEYYIENQVLPAVERILRAFGYRKEDLKYQKTKQVGLGAWLKF---------------     771
```

FIG. 155-5

```
Bst      MKKKLVLIDGNSVAYRAFFAIPLLHNDKGIHTNAVYGFTMMLNK--ILAEEQPTHLLVAF  58
RMF90    MA----------------------------------------RDLLLDIDYVTVDEKAQV---RLF  23
9oN      ------------------------------------------------MILDTDYITENGKPVI---RVF  19
Pfu      ------------------------------------------------MILDVDYITEEGKPVI---RLF  19
Pabyssi  ------------------------------------------------MIIDADYITEDGKPII---RIF  19
                                                         :.:: :. :..:   *

Bst      DAGKTTFRHETFQEYKGGRQQTPPELSEQFPLLRELLKAYRIPAYELDHYEADDIIGTLA  118
RMF90    LKDK-----ILF------------------D-----------------------------  31
9oN      KKENGEFKIEY-------------------D-----------------------------  31
Pfu      KKENGKFKIEH-------------------D-----------------------------  31
Pabyssi  KKEKGEFKVEY-------------------D-----------------------------  31
         ..

Bst      ARAEQEGFEVKIISGDRDLTQLASRHVTVDITKKGITDIEPYTPETVREKYGLTPEQIVD  178
RMF90    -------------------------------PGFQPYFYVLAHDG-------AVEER--  50
9oN      -------------------------------RTFEPYFYALLKDD-------SAIED--  50
Pfu      -------------------------------RTFRPYIYALLRDD-------SKIEE--  50
Pabyssi  -------------------------------RTFRPYIYALLKDD-------SAIDE--  50
                                        :.*                   :  :

Bst      LKGLMGDKSDNIPGVPGIGEKTAVKLLKQFGTVENVLASID-----------EVKGEK  225
RMF90    LR--------------------DFGAVEAVQRRMLGREMRFFEKLILSHPSEVPK  84
9oN      VKKVTAKRHGTVV---------KVKRAEKVQKKFLGRPIEVWKLYFNHPQDVPA  95
Pfu      VKKITGERHGKIV---------RIVDVEKVEKKFLGKPITVWKLYLEHPQDVPT  95
Pabyssi  VKKITAERHGKIV---------RITEVERVQKKFLGRPIEVWKLYLEHPQDVPA  95
         ::                    .  .* :
```

FIG. 156-1

```
Bst      LKENLRQHRDLALLSKQLASICRDAPVELSLDDIVYEGQDREKVIALFKELGFQSFLEKM        285
RMF90    IREEVRSIEGVEGIFEHDILFARRYLIDKGLTPLNYAE------YRA---EQGFLK-G        132
9oN      IRDRIRAHPAVVDIYEYDIPFAKRYLIDKGLIPA--------------------------      129
Pfu      IREKVREHPAVVDIFEYDIPFAKRYLIDKGLIPM--------------------------      129
Pabyssi  IREKIREHPAVVDIFEYDIPFAKRYLIDKGLTPM--------------------------      129
          : :.*   :   ::   ** :  :: ::*

Bst      AAPAAEGEKPLEEMEFAIVDVITEEMLADKAALVVEVMEENYHDAPIVGIALVNEHGRFF       345
RMF90    ISSAGEGPESLRVMAFDIETYNPK------------------GAPRAEKDPVIMLSLSTNTGLRR   179
9oN      ------EGDEELTMLAFDIETLYHE-----------------------GEE-FGTGPILMISYADGSEAR-    169
Pfu      ------EGEEELKILAFDIETLYHE-----------------------GEE-FGKGPIIMISYADENEAK-    169
Pabyssi  ------EGNEELTFLAVDIETLYHE-----------------------GEE-FGKGPIIMISYADEEGAK-    169
            * :    :*  . *:**  :                  **    :. :: .

Bst      MRPETALADSQFLAWLLADETKKKSMFDA--------KRAVVALKWKGIELRGVAFDLLLAA       398
RMF90    LLTYKSGEGLDFVELVEDE---KALLHRFKELVNEEGVEVLVGY-------NSDQFDL------P      228
9oN      VITWK-KIDLPYVDVVSTE---KEMIKRFLRVVREKDPDVLITY-------NGDNFDF------A      217
Pfu      VITWK-NIDLPYVEVVSSE---REMIKRFLRIIREKDPDIIVTY-------NGDSFDF------P      217
Pabyssi  VITWK-SIDLPYVEVVSSE---REMIKRFLVKVIREKDPDVIITY-------NGDNFDF------P      217
          .        .     .      : :: :   .    . ::   . .      **.

Bst      YLLINPAQDAGD-----------------IAA------------VAKMKQYEAVR        423
RMF90    YLVARAKALGVELPLGQDGSQPQIRKGRGLVESVKGRPHVDLYPIVRRNVRLSSYVLEN     288
9oN      YLKKRCEELGIKFTLGRDGSEPKIQRMGDRFAVEVKGRIHFDLYPVIRRTINLPTYTLEA    277
Pfu      YLAKRAEKLGIKLTIGRDGSEPKMQRIGDMTAVEVKGRIHFDLYHVITRTINLPTYTLEA    277
Pabyssi  YLLKRAEKLGIKLPLGRDNSEPKMQRMGDSLAVEIKGRIHFDLFPVIRRTINLPTYTLEA    277
         **  :        *                                :   *
```

FIG. 156-2

```
Bst      SDEAVYGKGVKRSLPDEQTLAEHLVRKAAAIWALEQPFMDDLRNNEQDQLLTKLEQPLAA       483
RMF90    VVKEVLGREKEKIPHDA----------MCGYWDRGGRELQRFMAY---------------       323
90N      VYEAVFGKPKEKVYAEE----------IAQAWESG-EGLERVARY---------------       311
Pfu      VYEAIFGKPKEKVYADE----------IAKAWESG-ENLERVAKY---------------       311
Pabyssi  VYEAIFGKSKEKVYAHE----------IAEAWETG-KGLERVAKY---------------       311
          :  :*:  :  ::                 * :   :  *  .

Bst      ILAEMEFTGVNVDTKRLEQMGSELAEQLRAIEQRIYELAGQEFNINSPKQLGVIL-----       538
RMF90    -SMED--------------ADVTLELAERFLPLYIELSRVVGLPLHDVARMTAGQLVEWLLI       370
90N      -SMED--------------AKVTYELGREFPMEAQLSRLIGQSIMDVSRSSTGNLVEWFLL       358
Pfu      -SMED--------------AKATYELGKEFLPMEIQLSRLVGQPLMDVSRSSTGNLVEWFLL       358
Pabyssi  -SMED--------------AKVTFELGKEFFPMEAQLARLVGQPVWDVSRSSTGNLVEWFLL       358
          ****                  .* :  * . : :*: .   :: . *     :

Bst      ----FEKLQLPV----------LKKKTKTGYSTSADVLEKLAPHHEIVENILHYRQLGKLQSTY       587
RMF90    REAFARGEVVPNKGSGREYLARSEDTYAGG---YVMEPVKGIVENIVVEDFRSLYPSII       426
90N      RKAYKRNELAPNKPDERELARR-RGGYAGG---YVKEPERGLWDNIVYLDFRSLYPSII       413
Pfu      RKAYERNEVAPNKPSEEEYQRRLRESYTGG---FVKEPEKGLWENIVYLDFRALYPSII       414
Pabyssi  RKAYERNELAPNKPDEREYERRLRESYEGG---YVKEPEKGLWEGIVSLDFRSLYPSII       414
           :                           .:: *                  *

Bst      IEGLLKVVRPDTGKVHTM--ENQALTQTGRLSSAEPNLQ-------N---IPIRLEEGRKIRQA       639
RMF90    VT---HNIDPATLRPGR--GENSPPELDYHFTEEEGFIPSVLKRVLERRLSAKRRMKEA       481
90N      IT----HNVSPDTLNREGCKEYDVAPEVGHKFCKDFPGFIPSLLGDLLEERQKIKRKMKAT       470
Pfu      IT----HNVSPDTLNLEGCKNYDIAPQVGHKFCKDIPGFIPSLLGHLLEERQKIKTKMKET       471
Pabyssi  IT----HNVSPDTLNRENCKEYDVAPQVGHRFCKDFPGFIPSLLGNLLEERQKIKKRMKES       471
                                                                   *         :: :: ::
```

FIG. 156-3

| | | |
|---|---|---|
| Bst | FVPSEPDWLIFAAADYSQIELRVLAHIADDDNLLEAFQRDLDIHTKTAMDIFHVSEEEVTA | 699 |
| RMF90 | RDPGEKR-----MLDISQRALKIIANSFYG----YMGYPRARWYKKECAESVTSFARMYTKK | 534 |
| 9oN | VDPLEKK------LLDYRQRAIKILANSFYG-----YYGYAKARWYCKECAESVTAWGREYIEM | 523 |
| Pfu | QDPIEKI------LLDYRQKAIKLLANSFYG-----YYGYAKARWYCKECAESVTAWGRKYIEL | 524 |
| Pabyssi | KDPVEKK-----LLDYRQRAIKILANSYYG-----YYGYAKARWYCKECAESVTAWGRQYIDL | 524 |
| | * *: ::*: . . *: . : |  |
| | | |
| Bst | NMRRQAKAVNFGIVYGISDYGLAQ-----NLNITRKEAAEFIERYFASFPGVKQYMENIVQ | 755 |
| RMF90 | VMAIAEEEYGFKVVYGDTDSLFIVVQPE--EKERAMSFMEDVNRRLPGTVELEYD---- | 587 |
| 9oN | VIRELEEKFGFKVLYADTDGLHATIPGADAETVKKAKEFLKYINPKLPGLLELEYE--- | 580 |
| Pfu | VWKELEEKFGFKVLYIDTDGLYATIPGGESEIKKALEFVKYINSKLPGLLELEYE--- | 581 |
| Pabyssi | VRRELE-SRGFKVLYIDTDGLYATIPGAKHEEIKEKALKFVEYINSKLPGLLELEYE--- | 580 |
| | .: *: .*: **.* :*** ::: |  |
| | | |
| Bst | EAKQKGYVTTLLHRRRYLPDITSRNFNVRSFAERTAMNTPIQGSAADIIKKAMIDLAARL | 815 |
| RMF90 | GFYPRGIF----ITKKRYALIDEKGNIVV-------KGLETVRRDWTRLSRD-- | 628 |
| 9oN | GFYVRGFF---VTKKKYAVIDEEGKITT-------RGLEIVRRDWSEIAKE- | 621 |
| Pfu | GFYKRGFF---VTKKRYAVIDEEGKVIT-------RGLEIVRRDWSEIAKE- | 622 |
| Pabyssi | GFYARGFF----VTKKKYALIDEEGKIVT-------RGLEIVRRDWSEIAKE- | 621 |
| | .: * :. :** * :: :. .:: |  |
| | | |
| Bst | KEEQLQARLLLQVHDELLIEAPKEEIERLCELVPEVMEQAVTLRVP---------L | 862 |
| RMF90 | ----TQQKVLSVI----LR---EGDPKKAADIVKDTINRLKERRVDLEDITYTQLTKGI | 677 |
| 9oN | ----TQARVLEAI----LK---HGDVEEAVRIVKEVTEKLSKYEVPPEKLVIHEQITRDL | 670 |
| Pfu | ----TQARVLETI----LK---HGDVEEAVRIVKEVIQKLANYEIPPEKLAIYEQITRPL | 671 |
| Pabyssi | ----TQAKVLEAI----LK---HGNVDEAVKIVKEVTEKLSKYEIPPEKLVIYEQITRPL | 670 |
| | * .: : :: |  |

FIG. 156-4

```
Bst       KVDYHYGPTWYDAK----------------------------------------------          876
RMF90     GRYKNVGPHVKAAQKAIDRGREVNPGMAIGYIIKKGRGLISDRAEPVED---ATIEDYDVD          735
9oN       RDYKATGPHVAVAKRLAARGVKIRPGTVISYIVLKGSGRIGDRAIPADEFDPTKHRYDAE           730
Pfu       HEYKAIGPHVAVAKKLAAKGVKIKPGMVIGYIVLRGDGPISNRAILAEEYDPKKHKYDAE           731
Pabyssi   SEYKAIGPHVAVAKRLAAKGVKVKPGMVIGYIVLRGDGPISKRATATEEFDPKKKHKYDAE          730
                  **                    * :

Bst       --------------------------------------                                 876
RMF90     YYIENQVLPPVARIMEVLGYSKEHLKEEM-VQGSLQRWF------                          773
9oN       YYIENQVLPAVERILKAFGYRKEDLRYQKTKQVGLGAWLKVKGKK                           775
Pfu       YYIENQVLPAVLRILEGFGYRKEDLRYQKTRQVGLTSWLNIKKS-                           775
Pabyssi   YYIENQVLPAVERILRAFGYRKEDLKYQKTKQVGLGAWLKF----                          771
```

FIG. 156-5

```
Bst       MKKKLVLIDGNSVAYRAFFALPLLHNDKGIHTNAVYGFTMMLNKILAEEQPTHLLVAFDA    60
MBC72     ------------------------------MRGLLFDVDIAEEEERPNVRLFVKVA       26
90N       -------------------------------MILDTDYITENGKPVIRVFKKEN         23
Pfu       -------------------------------MILDVDYITEEGKPVIRLFKKEN         23
Pabyssi   -------------------------------MIIDADYITEDGKPIIRIFKKEK         23
                                         :: ..*  *: :*::* :*.
Bst       GKTTFR-HETFQEYKGGRQQTPPELSEQFPLLRELLKAYRIPAYELDHYEADDIGTLAA    119
MBC72     SETVVAIDPQFEEYFYVADHPAKTS-----------------------------------  52
90N       GEFKIEYDRTFEPYFYALLKDDSAIE----------------------------------  49
Pfu       GKFKIEHDRTFRPYIYALLRDDSKIE----------------------------------  49
Pabyssi   GEFKVEYDRTFRPYIYALLKDDSAID----------------------------------  49
           :   :  :*. **:.* : .. : .
Bst       RAEQEGFEVKIISGDRDLTQLASRHVTVDITKKGITDIEPYTPETVREKYGLTPEQIVDL   179
MBC72     ----KLIEKIELDEGGR---------------PIRPKSVEMVRRTLLGNEVEAIRV      89
90N       ----DVKKVTAKRHGT----------------VVKVKRAEKVQKKFLGRPIEVWKL      85
Pfu       ----EVKKITGERHGK----------------IVRIVDVEKVEKKFLGKPITVWKL      85
Pabyssi   ----EVKKITAERHGK----------------IVRITEVEKVQKKFLGRPIEVWKL      85
           .  .              *.  . :*.*..::.: ..:
Bst       K---------GLMGDKSDNIPGVPGIGEKTAVKLLKQFGTVENVLASIDEVKGEKLKENLRQ   232
MBC72     SFHQPRDAAKLRHKIRELPGVKEIYEFDIP-PARRYLI-D----RGLTPMAGIEFSGSIEV   144
90N       YFNHPQDVPAIRDRIRAHPAVVDIYEYDIP-FAKRYLI-D----KGLIPAEGDEE-------  134
Pfu       YLEHPQDVPTIREKVREHPAVVDIFEYDIP-FAKRYLI-D----KGLIPMEGEEE-------  134
Pabyssi   YLEHPQDVPAIREKIREHPAVVDIFEYDIP-FAKRYLI-D----KGLTPMEGNEE-------  134
           :   *.: :   ::*  *::  *  *   :*: .*.:
```

FIG. 157-1

```
Bst      HRDLALLSKQLASTICRDAPVELSLDDIVYEGQDREKVTALFKELGFQSFLEKMAAPAAEG   292
MBC72    ----------------------RDGVKTVVMDG---------------PPKPAPVE       163
9oN      ------------------------------------------------------------   134
Pfu      ------------------------------------------------------------   134
Pabyssi  ------------------------------------------------------------   134

Bst      EKPLEEMEFAIVDVITEEMLADKAALVVEVMEENYHDAPTVGIALVNEHGRFFMRPETAL   352
MBC72    ETRLNIMSFDIEVYNP--------------------TGSVRPDKDPIIMISLADNRG---   200
9oN      ---LTMLAFDIETLYH-------------------------EGE-EFGTGPILMISYADGSE   167
Pfu      ---LKILAFDIETLYH-------------------------EGE-EFGKGPIIMISYADENE   167
Pabyssi  ---LTFLAVDIETLYH-------------------------EGE-EFGKGPIIMISYADEEG   167
             *  :                                 *  ::    *:.    .:

Bst      ADSQFLAWLADETKKKSMFDAKRAVVALKWKGIELRGVAF--------------------   392
MBC72    -------------------LRKVITWKNFDKKPEYVEVVGSEREMIKKFVELVKER       237
9oN      -------------------ARVITWKKIDL---PYVDVVSTEKEMIKRFLRVVREK       201
Pfu      -------------------AKVITWKNIDL---PYVEVVSSEREMIKRFLRIIREK       201
Pabyssi  -------------------AKVITWKSIDL---PYVEVVSSEREMIKRLVKVIREK       201
                            .:.**  *                .        :   :

Bst      ---------DLLLAAYLLNPAQDAGDI--------A------------------       411
MBC72    DVDILLGYNTDLFDLPYIRSRAKQLRVKLDLGRDGSELVVRKRRFATASKIRGRVHVDVF   297
9oN      DPDVLITYNGDNFDFAYLKKRCEELGIKFTLGRDGSEPKIQRMGDRFAVEVKGRIHFDLY   261
Pfu      DPDIIVTYNGDSFDEPYLAKRAEKLGIKLTIGRDGSEPKMQRIGDMTAVEVKGRIHFDLY   261
Pabyssi  DPDVITTYNGDNFDFPYLLKRAEKLGIKLPLGRDNSEPKMQRMGDSLAVEIKGRIHFDLF   261
             *         :  *: .  :   :     .
```

FIG. 157-2

```
Bst      ----------AVAKMKQYEAVRSDEAVYGKGVKRSLPDEQTLAEHLVRKAAAIWALEQPFM  462
MBC72    AMVDELATIGSIRLIHYSLADVYRHYAGREKPDEEF------------SEMINAWERGGDAG  347
9oN      PVIR-------RTINLPTYTLEAVYEAVFGKPKEKVYA------------EEIAQAWESGEGL-  305
Pfu      HVIT-------RTINLPTYTLEAVYEAIFGKPKEKVYA------------DEIAKAWESGENL-  305
Pabyssi  PVIR-------RTINLPTYTLEAVYEAIFGKSKEKVYA------------HEIAEAWETGKGL-  305
                    : *                                    *

Bst      DDLRNNEQDQLLTKLEQPLAAILAEMEFTGVNVDTKRLEQMGSELAEQLRAIEQRIYELA  522
MBC72    RRE-----------------LEYSM----SDADATLEVGSE----LLPLFLGLTRVV  379
9oN      ERV-----------------ARYSM----EDAKVTYELGRE----FFPMEAQLSRLI  337
Pfu      ERV-----------------AKYSM----EDAKATYELGKE----FLPMEIQLSRLV  337
Pabyssi  ERV-----------------AKYSM----EDAKVTFELGKE----FFPMEAQLARLV  337
                              *   :                 :           *

Bst      GQEFNIN----SPKQLGVIL-FEK-----LQL----PV----L-KKTKTGYSTSADVLEKLAP  566
MBC72    GQTLFDVQRMTPGQLVEWLLVAEAHRIGELVPPRPVGEEFEERAEGTFT-GAYVM---EP  435
9oN      GQSLWDVSRSSTGNLVEWFLLRKAYKRNELAPNKPDERELARR-RGGYA-GGYVK---EP  392
Pfu      GQPLWDVSRSSTGNLVEWFLLRKAYERNEVAPNKPSEEEYQRRLRESVT-GGFVK---EP  393
Pabyssi  GQPVWDVSRSSTGNLVEWFLLRKAYERNELAPNKPDEREYERRLRESYE-GGYVK---EP  393
          *  :       * :   :      :: :     :: ::          *

Bst      HHEIVENILHYRQLGKLQSTYIEGLLKVVRPDTGKVHTMFNQALTQTGRLSSAEPNLQNI  626
MBC72    VKGLHEDLVVFDFRSLYPSIIV---THNIDPSTLNCRDCKPG--------EREQV-----  479
9oN      ERGLWDNIVYLDFRSLYPSIII----THNVSPDTLNREGCKEY-----------DVA-  434
Pfu      EKGLWENIVYLDFRALYPSIII----THNVSPDTLNLEGCKNY-----------DIA-  435
Pabyssi  EKGLWEGIVSLDFRSLYPSIII----THNVSPDTLNRENCKEY-----------DVA-  435
          :  : :::          *

FIG. 157-3
```

```
Bst       PIRLEEGRKIRQAFVPSEPDWLIFAADYSQIELRVLAHIADDNLIEAFQRDLDIHTKTA    686
MBC72     PGLSYYFCKRRKGFIPAVLERVIEERTKLKAELKKIGRETREYRALDARQWAMKIVANSF    539
90N       PEVGHKFCKDFPGFIPSLLGDLLEERQKIKRKMKAT-VDPLEKKLLDYRQRAIKILANSF    493
Pfu       PQVGHKFCKDIPGFIPSLLGHLLEERQKIKTKMKET-QDPIEKILLDYRQKAIKLLANSF    494
Pabyssi   PQVGHRFCKDFPGFIPSLLGNLLEERQKIKKRMKES-KDPVEKKLLDYRQRAIKILANSY    494
                *   *::**  :  ::  ..  : *.:.   .  :. ::: *:::*::: :**.

Bst       MDIF--------------HVSEEEVTANMRRQAKAVNFGIVYGISDYGLAQN------L    725
MBC72     YGMLGYPRARWYSKQCAESVTSEGRHYIHRTI-EMAREEGLEVVYGDTDSLHCKLNGKTR    598
90N       YGYYGYAKARWYCKECAESVTAWGREYIEMVIRELEEKEGFKVLYADTDGLHATIPGADA    553
Pfu       YGYYGYAKARWYCKECAESVTAWGRKYIELVWKELEEKFGFKVLYIDTDGLYATIPGGES    554
Pabyssi   YGYYGYAKARWYCKECAESVTAWGRQYIDLVRRELE-SRGEKVLYIDTDGLYATIPGAKH    553
            .            ::  :  . :: .    .:  ::    *   *

Bst       NITRKEAAEFIERYFASFPGVKQYMENIVQEAKQKGYVTTLLHRRRYLPDITSRNFNVRS    785
MBC72     ----EEAMVFLRKVNESLPGIMELELE---GFYPRGIF----ITKKRYAMVDDEGRM---    644
90N       ETVKKKAKEFLKYINPKLPGLLELEYE---GFYVRGFF----VTKKRYAVIDEEGKI---    603
Pfu       EEIKKKALEFVKYINSKLPGLLELEYE---GFYKRGFF----VTKKRYAVIDEEGKV---    604
Pabyssi   EEIKEKALKFVEYINSKLPGLLELEYE---GFYARGFF----VTKKKYALIDEEGKI---    603
            ::  * : :  .:.  ::**: * *:.    **   .*   : : :.  :

Bst       FAERTAMNTPIQGSAADIIKKAMIDLAARLKEEQLQARLLLQVHDELILEAPKEEIERL-    844
MBC72     -------------VVKGLEFVRRDWAATAKKTQEEVLRAILRDGSP-KKAAEIIRKTTRDVY    692
90N       -------------TTRGLEIVRRDWSEIAKETQARVLEAILKHGDV-EEAVRIVKEVTEKLS    651
Pfu       -------------ITRGLEIVRRDWSEIAKETQARVLETILKHGDV-EEAVRIVKEVIQKLA    652
Pabyssi   -------------VTRGLEIVRRDWSEIAKETQAKVLEAILKHGNV-DEAVKIVKEVTEKLS    651
                          :  **:*:**:   *: **:::  :: ..  .:. *.   :.

FIG. 157-4
```

```
Bst       -CELVPEVMEQAVTLRVPLKVDYHYGPTWYDAK----------------------------   876
MBC72     EGRVNLEDLIIYTQLKMPIESYKAIGPHVVAAKRLRELGHEIEPGMMIAYIEVKGPGSIS   752
9oN       KYEVPPPEKLVIHEQITRDLRDYKATGPHVAVAKRLAARGVKIRPGTVISYIVLKGSGRIG   711
Pfu       NYEIPPEKLAIYEQITRPLHEYKAIGPHVAVAKKLAAKGVKIKPGMVIGYIVLRGDGPIS   712
Pabyssi   KYEIPPEKLVIYEQITRPLSEYKAIGPHVAVAKRLAAKGVKVKPGMVIGYIVLRGDGPIS   711
                  : :  .  :        **                                **

Bst       ------------------------------------------------------------   876
MBC72     DRAVPVEDFEG---KEYDPDYYVGHQILPAVMRIMEVLGYSEEDLKFEREKQIGLDRFMK-   809
9oN       DRAIPADEEDPTKHRYDAEYYIENQVLPAVERILKAFGYRKEDLRYQKTKQVGLGAWLKV   771
Pfu       NRAILAEEYDPKKHKYDAEYYIENQVLPAVLRILEGFGYRKEDLRYQKTRQVGLTSWLNI   772
Pabyssi   KRAIAIEEFDPKKHKYDAEYYIENQVLPAVERILRAFGYRKEDLKYQKTKQVGLGAWLKF   771

Bst       -----   876
MBC72     -----   809
9oN       KGKK   775
Pfu       KKS-   775
Pabyssi   -----   771
```

FIG. 157-5

```
Bst       MKKKLVLIIDGNSVAYRAFFALPLLHNDKGIHTNAVYGFTMMLNKILAEEQPTHLLVAFDA   60
WP175     ------------------------------------------MILDTDYITKDGKPIIRIFKK  21
90N       ------------------------------------------MILDTDYITENGKPVIRVFKK  21
Pfu       ------------------------------------------MILDVDYITEEGKPVIRLFKK  21
Pabyssi   ------------------------------------------MIIDADYITEDGKPIIRIFKK  21
                                                    *  ::  . :: ::*.

Bst       GKTTFRHETFQEYKGGRQQTPPELSEQFPLLRELLKAYRIPAYELDHYEADDIIGTLAAR    120
WP175     ENGEFKIELD--------------------------------------------------   31
90N       ENGEFKIEYD--------------------------------------------------   31
Pfu       ENGKFKIEHD--------------------------------------------------   31
Pabyssi   EKGEFKVEYD--------------------------------------------------   31
           : *:*: *

Bst       AEQEGFEVKIISGDRDLTQLASRHVTVDITKKGITDIEPYTPETVREKYGLTPEQIVDLK   180
WP175     --------------------------------PHFQPYIYALLKDD------SAIEEIK   52
90N       --------------------------------RTFEPYFYALLKDD------SAIEDVK   52
Pfu       --------------------------------RTFRPYIYALLRDD------SKIEEVK   52
Pabyssi   --------------------------------RTFRPYIYALLKDD------SAIDEVK   52
                                             :.**:.*: *        :::. *

Bst       GLMGDKSDNIPGVPGIGEKTAVKLLKQF--GTVENVLASID--EVKGEKLKENLRQHRDLA  237
WP175     AIKGERHGKTVRVLD-----AVKVRKKFLGREVEVWKLIFEHPQDVPAMRDKIKEHPA--  105
90N       KVTAKRHGTVVKVKR-----AEKVQKKFLGRPIEVWKLYFNHPQDVPAIRDRIRAHPA--  105
Pfu       KITGERHGKIVRIVD-----VEKVEKKFLGKPITVWKLYLEHPQDVPTIREKVREHPA--  105
Pabyssi   KITAERHGKIVRITE-----VEKVQKKFIGRPIEVWKLYLEHPQDVPAIREKIREHPA--  105
           :  .: *. : :            .* :*:*: : *:* ::: *:**   :: :.
```

FIG. 158-1

| | | |
|---|---|---|
| Bst | LLSKQLASICRDAPVELSLDDIVYEGGQDREKVIALFK-ELGF-QSFLEKMAAPAAEGEKP | 295 |
| WP175 | ------------------------------VIDIYEYDIPFAKRYLIDKGLIPMEGDEE | 134 |
| 9oN | ------------------------------VVDIYEYDIPFAKRYLIDKGLIPAEGDEE | 134 |
| Pfu | ------------------------------VVDIFEYDIPFAKRYLIDKGLIPMEGEEE | 134 |
| Pabyssi | ------------------------------VVDIFEYDIPFAKRYLIDKGLTPMEGNEE | 134 |
| | *: ::: :: *..:*::*.  . . | |
| Bst | LEEMEFAIVDVITEEMLADKAALVVEVMEENYHDAPIVGIALVNEHGRFFMRPETALADS | 355 |
| WP175 | LKLLAFDIETFYHE-------------------GDEFGKGEIMISYADEE--------E- | 167 |
| 9oN | LTMLAFDIETLYHE-------------------GEEFGTGPILMISYADGS--------- | 167 |
| Pfu | LKILAFDIETLYHE-------------------GEEFGKGPIIMISYADEN--------E- | 167 |
| Pabyssi | LTFLAVDIETLYHE-------------------GEEFGKGPIIMISYADEE--------G- | 167 |
| | *.: . * .:: ** *:: . | |
| Bst | QFLAWLADETKKKSMFDAKRAVVALKWKGIELRG-------------------------- | 389 |
| WP175 | ------------------ARVITWKNIDLPYVDVDVVSNEREMIKRFVQVVKEKDPDVI | 206 |
| 9oN | ------------------ARVITWKKIDLPYVDVDVVSTEKEMIKRFLRVVREKDPDVL | 206 |
| Pfu | ------------------ARVITWKNIDLPYVDVDVVSSEREMIKRFLRIIREKDPDII | 206 |
| Pabyssi | ------------------AKVITWKSIDLPYVEVVSSEREMIKRLVKVIREKDPDVI | 206 |
| | . .:: **  *:: | |
| Bst | ------VAFDLLLAAYLLNPAQDA---------------------GDIAAV--------- | 413 |
| WP175 | ITYNGDNFDL--PYLIKRAEKLGIRLVLGRDKENPEPKIQRMGDSFAVEIKGRIHFDLF | 263 |
| 9oN | ITYNGDNFDF---AYLKKKRCEELGIKFTLGRDG----SEPKIQRMGDRFAVEVKGRIHFDLY | 261 |
| Pfu | VTYNGDSFDF---PYLAKRAEKLGIKLTIGRDG----SEPKMQRIGDMTAVEVKGRIHFDLY | 261 |
| Pabyssi | ITYNGDNFDF---PYLLKRAEKLGIKLPLGRDN---SEPKMQRMGDSLAVEIKGRIHFDLF | 261 |
| | ** .: .: | |

FIG. 158-2

```
Bst       --------AKMKQYEAVRSDEAVYGKGVKRSLPDEQTLAEHLVRKAAAIWALEQPFMDDLRN        467
WP175     PVVRRTINLPTYTLEAVYEAVLGKTKSKLGA-------EEIAAIWETEESMKKLAQY           313
9oN       PVIRRTINLPTYTLEAVYEAVFGKPKEKVYA-------EEIAQAWESGEGLERVARY           311
Pfu       HVITRTINLPTYTLEAVYEAIFGKPKEKVYA-------DEIAKAWESGENLERVAKY           311
Pabyssi   PVIRRTINLPTYTLEAVYEAIFGKSKEKVYA-------HEIAEAWETGKGLERVAKY           311
                  * **  **                    *    *

Bst       NEQDQLLTKLEQPLAAILAEMEFTGVNVDTKRLEQMGSELAEQLRAIEQRIYELAGQEFN       527
WP175     SMED---------------------AR------ATYELGKEFFPMEAELAKLIGQSVW         344
9oN       SMED---------------------AK------VTYELGREFFPMEAQLSRLIGQSLW         342
Pfu       SMED---------------------AK------ATYELGKEFLPMEIQLSRLVGQPLW         342
Pabyssi   SMED---------------------AK------VTFELGKEFFPMEAQLARLVGQPVW         342
           *                          :    *        *      *   *  *

Bst       INSPKQLGVILFEKLQLPVLKKTKTGYSTSADVLEKLAPHHEIVENILHYRQLGKLQSTY       587
WP175     DVSRSSTGNLV-EWY---LLR---VAYA------RNELAPNKPDEEE-----YKRRLRTTY    387
9oN       DVSRSSTGNLV-EWF---LLR---KAYK------RNELAPNKPDERE-----LARR-RGGY    384
Pfu       DVSRSSTGNLV-EWF---LLR---KAYE------RNEVAPNKPSEEE-----YQRRLRESY    385
Pabyssi   DVSRSSTGNLV-EWF---LLR---KAYE------RNELAPNKPDERE-----YERRLRESY    385
                         *                 ** * **  :          *   *

Bst       IEGLLKVVRPDTGKVHTMFNQ-------ALTQTGRLSSAE----PNLQNIPIRLEEGRKIR      637
WP175     LGGYVKE--PEKGLWENTIYLDFRSLYPSIIVTHNVSPDTLEKEGCENYDIAPTVGYKFC      445
9oN       AGGYVKE--PERGLWDNIVYLDFRSLYPSIIITHNVSPDTLNREGCKEYDVAPEVGHKFC      442
Pfu       TGGFVKE--PEKGLWENIVYLDFRALYPSIIITHNVSPDTLNLEGCKNYDIAPQVGHKFC      443
Pabyssi   EGGYVKE--PEKGLWEGIVSLDFRSLYPSIIITHNVSPDTLNRENCKEYDVAPQVGHRFC      443
             *       * ***      ***   *   *   *           *        **
```

FIG. 15B-3

```
Bst        Q----AFVPSEPDWLI------------------------------FAADYSQIELRVLAHIADDDNLIEAF    675
WP175      KDFPGFIPSILGDLIAMRQEIKKKMKATIDPIEKKMLDYRQRAVKLLANSYYGY----MGY            502
9oN        KDFPGFIPSLLGDLLEERQKIKRKMKATVDPLEKKLLDYRQRAIKILANSFYGY----YGY            499
Pfu        KDIPGFIPSLLGHLLEERQKIKTKMKETQDPIEKILLDYRQKAIKLLANSFYGY----YGY            500
Pabyssi    KDFPGFIPSLLGNLLEERQKIKKRMKESKDPVEKKLLDYRQRAIKILANSYYGY----YGY            500
           . . :*:**                                         **  *  :::*:: .  ..

Bst        QRDLDIHTKTAMDIFHVSEEEVTANMRRQAKAVNFGIVYGISDYG------LAQNLNITRKE           731
WP175      PKARWYSKECAESVTAWGRHYIEMTIKELEEKFGFKVLYADTDGFYATIPGEKPEIIKKK           562
9oN        AKARWYCKECAESVTAWGREYIEMVIRELEEKFGFKVLYADTDGLHATIPGADAETVKKK           559
Pfu        AKARWYCKECAESVTAWGRKYIELVWKELEEKFGFKVLYIDTDGLYATIPGGESEEIKKK            560
Pabyssi    AKARWYCKECAESVTAWGRQYIDLVRRELE-SRGFKVLYIDTDGLYATIPGAKHEEIKEK            559
              *      :  . :  .*   :   ::  :*   .:*:* ::  *::      .

Bst        AAEFIERYFASFPGVKQYMENIVQEAKQKGYVTTLLHRRRYLPDITSRNFNVRSFAERTA            791
WP175      AREFLNYINSKLPGLLEL------------------------------EYEGFYLRGFFVTKK        595
9oN        AKEFLKYINPKLPGLLEL------------------------------EYEGFYVRGFFVTKK        592
Pfu        ALEFVKYINSKLPGLLEL------------------------------EYEGFYKRGFFVTKK        593
Pabyssi    ALKFVEYINSKLPGLLEL------------------------------EYEGFYARGFFVTKK        592
           * :*  :   .  :***:                                 .:**:  **  .

Bst        MNT------PIQGSAADIIKKAMIDLAARLKEEQLQARLLLQVHDELILEAPKEEIERLC           845
WP175      RYAVIDEEGRITTRGLEVVRRDWSEIAKE----TQAKVLEAI----L----KDGSVEKAV         643
9oN        KYAVIDEEGKITTRGLEIVRRDWSEIAKE----TQARVLEAI----L----KHGDVEEAV         640
Pfu        RYAVIDEEGKVITRGLEIVRRDWSEIAKE----TQARVLETI----L----KHGDVEEAV         641
Pabyssi    KYALIDEEGKIVTRGLEIVRRDWSEIAKE----TQAKVLEAI----L----KHGNVDEAV         640
           :   : ::. :  *::::: *::::: *      *:: *: :                :
```

FIG. 158-4

```
Bst       ELVPEVMEQAVTLRVPLK--------------------VDYHYGPTWYDAK--------------  876
WP175     EIVRDVVEKIAKYRVPLEKLVIHEQITRDLKDYKAIGPHVSIAKRLATRGIKVKPGTIIS-----  703
9oN       RIVKEVTEKLSKYEVPPEKLVIHEQITRDLRDYKATGPHVAVAKRLAARGVKIRPGTVIS-----  700
Pfu       RIVKEVIQKLANYEIPPEKLAIYEQITRPLHEYKAIGPHVAVAKKLAAKGVKIKPGMVIG-----  701
Pabyssi   KIVKEVTEKLSKYEIPPEKLVIYEQITRPLSEYKAIGPHVAVAKRLAAKGVKVKPGMVIG-----  700
          .:*   :  ::  .   **   .   :.*   . * :  **     **

Bst       -----------------------------------------------------------------  876
WP175     YLVLKGGGRISDRVILLTEYDPEKHKYDPDYYIENQVLPAVLRILEAFGYRKEDLRYQSS      763
9oN       YIVLKGSGRIGDRAIPADEFDPTKHRYDAEYYIENQVLPAVERILKAFGYRKEDLRYQKT      760
Pfu       YIVLRGDGPISNRAILAEEYDPKKHKYDAEYYIENQVLPAVLRILEGFGYRKEDLRYQKT      761
Pabyssi   YIVLRGDGPISKRAIAIEEFDPKKHKYDAEYYIENQVLPAVERILRAFGYRKEDLKYQKT      760

Bst       ---------------  876
WP175     KQTGLDAWLKR----  774
9oN       KQVGLGAWLKVKGKK  775
Pfu       RQVGLTSWLNIKKS-  775
Pabyssi   KQVGLGAWLKF----  771
```

FIG. 158-5

```
Bst      MKKKLVLIDGNSVAYRAFFALPLLHNDKGIHTNAVYGFTMMLNKILAEEQPTHLLIVAFDA    60
KUO42    ------------------------------------MLLDVDYAEEEEKPSIRLFVK        21
9oN      ------------------------------------MILDTDYITENGKPVIRVFKK        21
Pfu      ------------------------------------MILDVDYITEEGKPVIRLFKK        21
Pabyssi  ------------------------------------MIIDADYITEDGKPIIRIFKK        21
                                             *:  *:   .*  *

Bst      GKTTFRH----ETFQEYKGGRQQTPPELSEQFPLLRELLKAYRIPAYELDHYEADDIIGTL   117
KUO42    TGSEVLVAIDPDFEEYFYVVSDHPAKASK----------------------LIEK-         54
9oN      ENGEFKIEYDRTFEPYFYALLKDDSAI-E----------------------DVKK-         53
Pfu      ENGKFKIEHDRTFERPIYALIRDDSKI-E----------------------EVKK-         53
Pabyssi  EKGEFKVEYDRTFERPIYALLKDDSAI-D----------------------EVKK-         53
              *:  :                                         ::

Bst      AARAEQEGFEVKIISGDRDLTQLASRHVTVD------------------------ITKKGITDIEPY   160
KUO42    -VEVEEDGVSIRPKGVEIVKRTFLGNEVEAIKVSFYQAKDSSKLRHKIRELPGVREIYEF         113
9oN      -VTAKRHGTVVKRAEKVQKKFLGRPIEVWKLYFNHPQDVPAIRDRIRAHPAVVDIYEY          112
Pfu      -ITGERHGKIVRIVDVEKVEKKFLGKPITVWKLYLEHPQDVPTIREKVREHPAVVDIFEY        112
Pabyssi  -ITAERHGKIVRITEVEKVQKKFLGRPIEVWKLYLEHPQDVPAIREKIREHPAVVDIFEY        112
          :   . *  *                          ::    .

Bst      TPET---VREKYGLTPEQIVDLKGLMGDKSDNIPGVPGIGEKTAVKLLKQFGTVENVLAS   217
KUO42    DIPPARRYLIDRGLTPMAGVEFDGRIEERQG-------I--------------KTVILDS   152
9oN      DIPFAKRYLIDKGLIPAEGDE-----------------------------------     133
Pfu      DIPFAKRYLIDKGLIPMEGEE-----------------------------------     133
Pabyssi  DIPFAKRYLIDKGLTPMEGNE-----------------------------------     133
         **  * *:**.**  :

FIG. 159-1
```

| | | |
|---|---|---|
| Bst | IDEVKGEKLKENLRQHRDLALLSKQLASICRDAPVELSLDDIV-----YEGQDR--EKVIALF | 273 |
| KUO42 | P------PRPAQVEEPKLNIMSFDIEVYNPTGSVRPDKDPIIMISLADNNGLRKVIT-W | 204 |
| 9oN | ----------------ELTMLAFDIETLYHEGE--EFGTGPILMISYADGSEA--RVIT-W | 173 |
| Pfu | ----------------ELKILAFDIETLYHEGE--EFGKGPIIMISYADENEA--KVIT-W | 173 |
| Pabyssi | ----------------ELTFLAVDIETLYHEGE--EFGKGPIIMISYADEEGA--KVIT-W | 173 |
| | . * ::. . : :**:  :: |
| Bst | KELG-FQSFLEKMAAPAAEGEKPLEEMEFAIVDVITEEMLADKAALVVEVMEENYHDAPI | 332 |
| KUO42 | KNFERSQEYVEVV--------GSEREMIKRFVDLVKER---------------DVD---- | 237 |
| 9oN | KKID--LPYVDVV--------STEKEMIKRFLRVVREK---------------DPD---- | 204 |
| Pfu | KNID--LPYVEVV--------SSEREMIKRFLRIIREK---------------DPD---- | 204 |
| Pabyssi | KSID--LPYVEVV--------SSEREMIKRLVKVIREK---------------DPD---- | 204 |
| | *.:: :: ** .  : * |
| Bst | VGIALVNEHGREFMRPETALADSQFLAWLADETKKKSM------------FDAKRAVVALKWK | 383 |
| KUO42 | I----LLGYNTDLFDL---------PYIRSRAKQLKVKLDLGRDGSELVVRKRRFATASKIR | 286 |
| 9oN | V----LITYNGDNFDE---------AYLKKRCEELGIKFTLGRDGSEPKIQRMGDRFAVEVK | 253 |
| Pfu | I----IVTYNGDSFDF---------PYLAKRAEKLGIKLTIGRDGSEPKMQRIGDMTAVEVK | 253 |
| Pabyssi | V----IITYNGDNFDE---------PYLLKRAEKLGIKLPLGRDNSEPKMQRMGDSLAVEIK | 253 |
| | : .  * :: * |
| Bst | GIELRGVAFDLLAAYLLNPAQDAGDIAAVAKMKQYEAVRSDEAVYGKGVKRSLPDEQTL | 443 |
| KUO42 | G----RIHVDVFAMVDFLAT-------IGSIKLIHYSLADVYRHLLGKEKPDFEFT---- | 331 |
| 9oN | G-------RIHFDLYPVIR--------RTINLPTYTLEAVYEAVFGKPKEKVYAE---- | 293 |
| Pfu | G-------RIHFDLYHVIT--------RTINLPTYTLEAVYEAIFGKPKEKVYAD---- | 293 |
| Pabyssi | G-------RIHFDLFPVIR--------RTINLPTYTLEAVYEAIFGKSKEKVYAH---- | 293 |
| | * . * ** |

FIG. 159-2

```
Bst        AEHLVRKAAAIWALEQPFMDDLRNNEQDLLTKLEQPLAAILAEMEFTGVNVDTKRLEQM              503
KUO42      ------------EMVDAWEKGGDAGRKFLEY--------SMS---------DADATLEV              361
9oN        ------------ETAQAWESGEGL-ERVARY--------SME---------DAKVTYEL              322
Pfu        ------------EIAKAWESGENL-ERVAKY--------SME---------DAKATYEL              322
Pabyssi    ------------ETAEAWETGKGL-ERVAKY--------SME---------DAKVTFEL              322
                         :  *    ..  .                             *: ::

Bst        GSELAEQLRAIEQRIYELAGQEFNIN----SPKQLGVIL-FEK------LQLPVLK---                548
KUO42      G----LELLPLFLGLTRVVGQTLFDVQRMTPGQLVEWLLVAEAHRIGELVPGRPVGEEYE              417
9oN        G----REFFPMEAQLSRLIGQSLWDVSRSSTGNLVEWFLLRKAYKRNELAPNKPDERELA              378
Pfu        G----KEFLPMEIQLSRLVGQPLWDVSRSSTGNLVEWFLLRKAYERNEVAPNKPSEEEYQ              378
Pabyssi    G----KEFFPMEAQLARLVGQPVWDVSRSSTGNLVEWFLLRKAYERNELAPNKPDEREYE              378
           *          :  :  *   .                  ::       . ::

Bst        -KTKTGYSTSADVLEKLAPHHETVENILHYRQLGKLQSTYIEGLLKVVRPDTGKVHTMFN              607
KUO42      ERMEETFVG-AYV----MEPVKGLHENLVFDFRSLYPSIIV----THNIDPSTLNCKDCKP             470
9oN        RR-RGGYAG-GYV----KEPERGLWDNIVYLDFRSLYPSIII---THNVSPDTLNREGCKE             430
Pfu        RRLRESYTG-GFV----KEPEKGLWENIVYLDFRALYPSIII---THNVSPDTLNLEGCKN             431
Pabyssi    RRLRESYEG-GYV----KEPEKGLWEGIVSLDFRSLYPSIII---THNVSPDTLNRENCKE             431
             .         *      *  : :    : :*: ***:*     ** .   : .

Bst        QALTQTGRLSSAEPNLQNIPIRLEEGRKIRQAFVPSEPDWLIFAADYSQIELRPVLAHIAD             667
KUO42      GER------EQVPGLE---YYFCRRRKGFIPATLQRIIEERMKLKAELKKLVRGTK                  517
9oN        YD----------VAPEVG------HKFCKDFPGFIPSLLGDLLEERQKIKRKMKATV-DPL            474
Pfu        YD----------IAPQVG------HKFCKDIPGFIPSLLGHLLEERQKIKTKMKETQ-DPI            475
Pabyssi    YD----------VAPQVG------HRFCKDFPGFIPSLLGNLLEERQKIKKRMKESK-DPV            475
                     .          *  *   **:  *::     :   :

FIG. 159-3
```

```
Bst       DDNLIEAFQRDLDIHTKTAMDIFH------------------VSEEEVTANMRRQAKAVNF  710
KUO42     EYRALDARQWAMKIVANSFYGMLGYPRARWYSKECAESVTSFGRHYIHKTID--MAREFGL  576
9oN       EKKLLDYRQRAIKILANSFYGYYGYAKARWYCKECAESVTAWGREYIEMVIRELEEKFGF  534
Pfu       EKILLDYRQKAIKLLANSFYGYYGYAKARWYCKECAESVTAWGRKYIELVWKELEEKFGF  535
Pabyssi   EKKLLDYRQRAIKILANSYYGYYGYAKARWYCKECAESVTAWGRQYIDLVRRELE-SRGF  534
           :  ::: ** : : :*:*       :* .:  : * ****..* ..* : : : : :

Bst       GIVYGISDYGLAQN------LNITRKEAAEFFTERYFASFPGVKQYMENIVQEAKQKGYVTTL  766
KUO42     EVVYGDTDSLHCKLNGKTR----EEALAFLKKVNDSLPGIMELELE----GFYPRGIF---  626
9oN       KVLYIDTDGLHATIPGADAETVKKKAKEFLKYINPKLPGLLELEYE----GFYVRGFF---  588
Pfu       KVLYIDTDGLYATIPGGESEIKKKALEFVKYINSKLPGLLELEYE----GFYKRGFF---  589
Pabyssi   KVLYIDTDGLYATIPGAKHEEIKEKALKFVEYINSKLPGLLELEYE----GFYARGFF---  588
           :* * : : *    .            :: *:: *::.*: ***:*    ** .*:*

Bst       LHRRRYLPDITSRNFNVRSFAERTAMNTPIQGSAADIIKKAMIDLAARLKEEQLQARLLL  826
KUO42     ITKKRYAMIDDEGRM----------------VVKGLEFVRRDWAAIAKKTQEEVLKAILRD  671
9oN       VTKKKYAVIDEEGKI----------------TTRGLEIVRRDWSEIAKETQARVLEAILKH  633
Pfu       VTKKRYAVIDEEGKV----------------ITRGLEIVRRDWSEIAKETQARVLETILKH  634
Pabyssi   VTKKKYALIDEEGKI----------------VTRGLEIVRRDWSEIAKETQAKVLEAILKH  633
           :*::* ::**:      .              . . *::*** : * *::.:**  : :

Bst       QVHDELILEAPKEEIERL--CELVPEVMEQAVTLRVPLKVDYHYGPTWYDAK--------  876
KUO42     G-SPEKAAEIIRKTTRDVYEGRVNLEDLIIYTQLKMPIESYKAIGPHVVAAKRLRELGHE  730
9oN       G-DVEEAVRIVKEVTEKLSKYEVPPEKLVIHEQITRDLRDYKATGPHVAVAKKLAARGVK  692
Pfu       G-DVEEAVRIVKEVIQKLANYEIPPEKLAIYEQITRPLHEYKAIGPHVAVAKKLAAKGVK  693
Pabyssi   G-NVDEAVKIVKEVTEKLSKYEIPPEKLVIYEQITRPLSEYKAIGPHVAVAKRLAAKGVK  692
           .  . :   : :.     .  *: *::* ::::: .:  :*.:**:*. *:*   :
```

FIG. 159-4

```
Bst       ------------------------------------------------------------  
KU042     IEPGMMIAYVEVKGPGSISERAVPVEDFK--GREYDPDYYVGHQVLPAVMRIMEVLGYRE  876
9oN       IRPGTVISYIVLKGSGRIGDRAIPADEFDPTKHRYDAEYYIENQVLPAVERILKAFGYRK  788
Pfu       IKPGMVIGYIVLRGDGPISNRAILAEEYDPKKHKYDAEYYIENQVLPAVLRILEGFGYRK  752
Pabyssi   VKPGMVIGYIVLRGDGPISKRAIAIEEFDPKKHKYDAEYYIENQVLPAVERILRAFGYRK  753
                                                                         752

Bst       -----------------------------
KU042     IDLKFERQRQVGLDRFMK-----       876
9oN       EDLRYQKTRQVGLGAWLKVGKK        806
Pfu       EDLRYQKTRQVGLTSWLNIKKS-       775
Pabyssi   EDLKYQKTRQVGLGAWLKF----       775
                                        771
```

FIG. 159-5

```
Bst       MKKKLVLIDGNSVAYRAFFALPLLHNDKGIHTNAVYGFTMMLNKILAEEQPTHLLIVAFDA      60
NOZ77     ------------------------------------MDGFLLDVDYKTVDEKPVVRLFLRDV      26
90N       ------------------------------------MILDTDYITENGKPVIRVFKKEN         23
Pfu       ------------------------------------MILDVDYITEEGKPVIRLFKKEN         23
Pabyssi   ------------------------------------MIIDADYITEDGKPIIRIFKKEK         23
                                              :  : * *:  .*: .  :

Bst       GKTTFRH-ETFQEYKGGRQQTPPELSEQFPLLRELLKAYRIPAYELDHYEADDIGTLAA      119
NOZ77     -----IALDPSERPYVYVACDDPR----------------------AVAGEIKDLE--       55
90N       GEFKIEYDRTFEPYFYALLKDDS-----------------------AIEDV-KKVTA        56
Pfu       GKFKIEHDRTFRPYIYALLRDDS-----------------------KIEEV-KKITG        56
Pabyssi   GEFKVEYDRTFRPYIYALLKDDS-----------------------AIDEV-KKITA        56
             : : :  *.                                      :.  *:

Bst       RAEQEGFEVKIISGDRDLTQLASRHVTVDITKKGITDIEPYTPETVREKYGLTPEQIVDL     179
NOZ77     ---LDGRRPVTGV--------------EEMERGLL----GRPRRFLKVYLGHPQQVPRV      93
90N       ---KRHGTVVKVKRA------------EKVQKKFL----GRPIEVWKLYFNHPQDVPAI      96
Pfu       ---ERHGKIVRIVDV------------EKVEKKFL----GKPITVWKLYLEHPQDVPTI      96
Pabyssi   ---ERHGKIVRITEV------------EKVQKKFL----GRPIEVWKLYLEHPQDVPAI      96
             .                         *  :. :    *:* .. *  ..*  :

Bst       KGLMGDKSDNIPGVPGIGEKTAVKLLKQFGTVENVLASIDEVKGEKLKENIRQHRDLALL     239
NOZ77     R-----DLLRRLPGVSAVLEDDIL-FSRRY---------------------------LI     119
90N       R-----DRIRAHPAVVDIYEYDIP-FAKRY---------------------------LI     122
Pfu       R-----EKVREHPAVVDIFEYDIP-FAKRY---------------------------LI     122
Pabyssi   R-----EKIREHPAVVDIFEYDIP-FAKRY---------------------------LI     122
                 :  .  . ::  :                                      *:
```

FIG. 160-1

```
Bst       SKQLASICRDAPVELSLDDIVYEGQDREKVIALFKELGFQSFLEKMAAPAAEGEKPLEEM    299
NOZ77     DKGLVPT--------ANVELQG------RVEGSEFWV-------EEVRRAEGPLPRL     155
9oN       DKGLIPA--------EGD----------------------------------EEL      135
Pfu       DKGLIPM--------EGE----------------------------------EEL      135
Pabyssi   DKGLTPM--------EGN----------------------------------EEL      135
          . * *           .                                    **:

Bst       EFAIVDVITEEMLADKAALVVEVMEENYHDAPIVGIALVNEHGR--FFMRPETALADSQEL  358
NOZ77     KVMSFDIETYNPK----------GAPRGDQDPIIMVSMATSGLRKVLSWKAPTAGLEFV   205
9oN       TMLAFDIETLYHE----------GEEFG-TGPILMISYADGSE-ARVITWKK--IDLPYV   181
Pfu       KILAFDIETLYHE----------GEEFG-KGPIIMISYADENE-AKVITWKN--IDLPYV   181
Pabyssi   TFLAVDIETLYHE----------GEEFG-KGPIIMISYADEEG-AKVITWKS--IDLPYV   181
          . *:   :              **:      . .  :    .         .   :

Bst       AWLADETKKKSMF-----DAKRAVVALKWKGIELRGVAFDLLLAAYLLNPAQDA------  407
NOZ77     ETLEDEAAVLRRFEELVRQEDPDILVGY---NTDNFDF----PYLNQRLKALGIELALG   257
9oN       DVVSTEKEMIKRFLRVVREKDPDVLITY------NGDNFDF-----AYLKKRCEELGIKFTLG  233
Pfu       EVVSSEREMIKRFLRIIREKDPDIIVTY------NGDSFDF-----PYLAKRAEKLGIKLTIG  233
Pabyssi   EVVSSEREMIKRLVKVIREKDPDVIITY------NGDNFDF-----PYLLKRAEKLGIKLPLG  233
          :      :::   :    :   *:              * **:.       . ::

Bst       ------GDIA-----AVAKMK-------QYEAVRSDEAVYGKGVKRSLPD     439
NOZ77     RDGSPHKTSTRMGMSETRMAGRPHMDLYPIVRRSLRLPSYVLEDVVAEVLGEEKEKVPG-  316
9oN       RDGSEPKIQRMGDRFAVEVKGRIHFDLYPVIRRTINLPTYTLEAVYEAVFGKPKEKVYA-  292
Pfu       RDGSEPKMQRIGDMTAVEVKGRIHFDLYHVITRTINLPTYTLEAVYEAIFGKPKEKVYA-  292
Pabyssi   RDNSEPKMQRMGDSLAVEIKGRIHFDLFPVIRRTINLPTYTLEAVYEAIFGKSKEKVYA-  292
                                *                       . ::
```

FIG. 160-2

```
Bst       EQTLAEHLVRKAAAIWALEQPFMDDLRNNEQDQLLTKLEQPLAAILAEMEFTGVNVDTKR    499
NOZ77     ----------------ERMGEINDKGGEELDRFFRYS--------LED----------AE-    342
9oN       ----------------EEIAQAWES-GEGLERVARYS--------MED----------AK-    317
Pfu       ----------------DEIAKAWES-GENLERVAKYS--------MED----------AK-    317
Pabyssi   ----------------HETAEAWET-GKGLERVAKYS--------MED----------AK-    317
                                                                    ::

Bst       LEQMGSELAEQLRAIEQRIYELAGQEENINSPKQLGVIL--------FEKLQLPVL-----    547
NOZ77     ----VTLRIGEKYLPLYIELSRLVGQSIHDVARMTAGQLVEWYLMREAFARGEVIPERPGG    399
9oN       ----VTYELGREFFPMEAQLSRLIGQSLWDVSRSSTGNLVEWFLLRKAYKRNELAPNKPDE    374
Pfu       ----ATYELGKEFLPMEIQLSRLVGQPLWDVSRSSTGNLVEWFLLRKAYERNEVAPNKPSE    374
Pabyssi   ----VTFELGKEFFPMEAQLARLVGQPVWDVSRSSTGNLVEWFLLRKAYERNELAPNKPDE    374
                  :          *       ::        :  **                ::

Bst       -----KKTKTGYSTSADVLEKLAPHHEIVENILHYRQLGKLQSTYIEGLLKVVRPDTGKVH    603
NOZ77     REFARRAGDTYEGG------YVREPRKGLLEKV--FDFRSLYPSVIV--THNIDPSTIRPG    450
9oN       RELARR-RGGYAGG------YVKEPERGLWDNIVYLDFRSLYPSIII---THNVSPDTLNRE    426
Pfu       EEYQRRLRESYTGG------FVKEPEKGLWENIVYLDFRALYPSIII---THNVSPDTLNLE    427
Pabyssi   REYERRLRESYEGG------YVKEPEKGLWEGIVSLDFRSLYPSIII---THNVSPDTLNRE    427
                *                    *                  *  *.     *

Bst       TM--FNQALTQTGRLSSAEPNLQNIPI-------RLEEGRK-----IRQAFVPSEPDWLIFAAD    653
NOZ77     PG--ENQPPGIDYHFTTEKEGF---IPALLIKRLVARRAELKEEMKKARDPGERK----MLD    502
9oN       GCKEYDVAPEVGHKFCKDFPGF---IPSLLGDLLEERQKIKRKMKATVDPLEKK----LLD    480
Pfu       GCKNYDIAPQVGHKFCKDIPGF---IPSLLGHLLEERQKIKTKMKETQDPIEKI----LLD    481
Pabyssi   NCKEYDVAPQVGHRFCKDFPGF---IPSLLGNLLEERQKIKKRMKESKDPVEKK----LLD    481
                               *                                      *
```

FIG. 160-3

```
Bst       YSQIELRVLAHIADDDNLIEAFQRDLDIHTKTAMDIFHVSEEEVTANMRRQAKAVNFGIV        713
NOZ77     VQQQALKILANSFYG----YMGYPRARWYRKECAESVTAFARDYIKKVMEVAEKEFGLEVV    559
9oN       YRQRAIKILANSFYG----YYGYAKARWYCKECAESVTAWGREYIEMVIRELEEKFGFKVL    537
Pfu       YRQKAIKLLANSFYG----YYGYAKARWYCKECAESVTAWGRKYIELVWKELEEKFGFKVL    538
Pabyssi   YRQRAIKILANSYYG----YYGYAKARWYCKECAESVTAWGRQYIDLVRRELE-SRGFKVL    537
            *   :: :***:         * *:* *                :  :   ::

Bst       YGISDYGLAQN------LNITRKEAAEFIERYFASFPGVKQYMENIVQEAKQKGYVTTLLHR    769
NOZ77     YGDTDSLFILVPGGKK------ERAFAFLEEVNRRLPGTIELEYE----GFYRRGIF----VTK    609
9oN       YADTDGLHATIPGADAETVKKKAKEFLKYIINPKLPGLLELEYE----GFYVRGFF----VTK    591
Pfu       YIDTDGLYATIPGGESEEIKKKALEFVKYINSKLPGLLELEYE----GFYKRGFF----VTK    592
Pabyssi   YIDTDGLYATIPGAKHEEIKEKALKFVEYINSKLPGLLELEYE----GFYARGFF----VTK    591
            *  :       *:      :: *         : *:.

Bst       RRYLPDITSRNFNVRSFAERTAMNTPIQGSAADIIKKAMIDLAARLKEEQLQARLLLQVH        829
NOZ77     KRYALIDEKD-----------------RIIVKGLEFVRRDWAPIARDT----QEKVLK----    646
9oN       KKYAVIDEEG-----------------KITTRGLEIVRRDWSEIAKET----QARVLE----    628
Pfu       KRYAVIDEEG-----------------KVITRGLEIVRRDWSEIAKET----QARVLE----    629
Pabyssi   KKYALIDEEG-----------------KIVTRGLEIVRRDWSEIAKET----QAKVLE----    628
          :*                            :: :::                *

Bst       DELILEAPKEEIERLCELVPEVMEQAVTLRVPLKV----------------DYHYGPTWYDAK    876
NOZ77     -ALLKDA---SPEEAVRIVRKAMDDIRARRVSLEDLTIYTQLTKK--------------    687
9oN       -AILKHG---DVEEAVRIVKEVTEKLSKYEVPPEKLVIHEQITRDLRDYKATGPHVAVAK    684
Pfu       -TILKHG---DVEEAVRIVKEVIQKLANYEIPPEKLAIYEQITRPLHEYKAIGPHVAVAK    685
Pabyssi   -AILKHG---NVDEAVKIVKEVTEKLSKYEIPPEKLVIYEQITRPLSEYKAIGPHVAIGK    684
           :  :       : **: *:  :  :  . : ::

FIG. 160-4
```

```
Bst       ------------------------------------------------------------  876
NOZ77     ------------------------------------------------------------  687
9oN       RLAARGVKIRPGTVISYIVLKGSSGRIGDRAIPADEFDPTKHRYDAEYYIENQVLPAVERI  744
Pfu       KLAAKGVKIKPGMVIGYIVLRGDGPISNRALLAEEYDPKKHKYDAEYYIENQVLPAVLRI   745
Pabyssi   RLAAKGVKVKPGMVIGYIVLRGDGPISKRAIAIEEFDPKKHKYDAEYYIENQVLPAVERI  744

Bst       ------------------------------------------  876
NOZ77     ------------------------------------------  687
9oN       LKAFGYRKEDLRYQKTKQVGLGAWLKVKGKK            775
Pfu       LEGFGYRKEDLRYQKTRQVGLTSWLNIKKS-            775
Pabyssi   LRAFGYRKEDLKYQKTKQVGLGAWLKF----            771
```

FIG. 160-5

COMPOSITIONS AND METHODS FOR PAIRWISE SEQUENCING

RELATED APPLICATIONS

This application is a continuation in part of U.S. patent application Ser. No. 17/521,239, filed on Nov. 8, 2021, which is a continuation of U.S. patent application Ser. No. 17/377,284, filed Jul. 15, 2021, now issued as U.S. Pat. No. 11,220,707, which claims the benefit of and priority to U.S. Provisional Application No. 63/212,059, filed on Jun. 17, 2021, the contents of each of which are incorporated herein by reference in their entireties.

COMPOSITIONS AND METHODS FOR PAIRWISE SEQUENCING

Throughout this application various publications, patents, and/or patent applications are referenced. The disclosures of the publications, patents and/or patent applications are hereby incorporated by reference in their entireties into this application in order to more fully describe the state of the art to which this disclosure pertains.

INCORPORATION BY REFERENCE OF SEQUENCE LISTING

The Sequence Listing XML associated with this application is provided electronically in XML file format and is hereby incorporated by reference into the specification. The name of the XML file containing the Sequence Listing XML is "ELEM-020_X01US_SeqListing.xml". The XML file is 5,066,000 bytes in size, created on Feb. 6, 2023, and is being submitted electronically via USPTO Patent Center.

TECHNICAL FIELD

The present disclosure provides compositions and methods that employ the compositions for conducting pairwise sequencing and for generating concatemer template molecules for pairwise sequencing.

BACKGROUND OF THE INVENTION

Polynucleotide sequencing technology has applications in biomedical research and healthcare settings. Improved methods of polynucleotide require enhanced surface chemistry, on-support polynucleotide amplification, and base calling. Currently, these elements produce barriers in existing sequencing technology that result in limits in throughput and poor signal-to-noise ratio, and ultimately to increased costs associated with polynucleotide sequencing.

There exists a need for new polynucleotide sequencing methods with improved surface chemistry, on-support amplification, and base calling. The present disclosure provides methods and compositions to improve sequencing of polynucleotides.

SUMMARY OF THE INVENTION

The present disclosure provides a method for pairwise sequencing, comprising: (a) providing a plurality of single stranded nucleic acid concatemer template molecules immobilized to a support; (b) sequencing the plurality of immobilized concatemer template molecules with a first plurality of sequencing polymerases, a plurality of soluble forward sequencing primers and a first plurality of multivalent molecules, thereby generating a plurality of extended forward sequencing primer strands; (c) retaining the plurality of immobilized concatemer template molecules and replacing the plurality of extended forward sequencing primer strands with a plurality of forward extension strands that are hybridized to the retained immobilized concatemer template molecules by conducting a primer extension reaction; (d) removing the retained immobilized concatemer template molecules while retaining the plurality of forward extension strands and retaining the plurality of immobilized surface primers; and (e) sequencing the plurality of retained forward extension strands with a second plurality of sequencing polymerases, a plurality of soluble reverse sequencing primers and a second plurality of multivalent molecules, wherein individual multivalent molecules in the first plurality of multivalent molecules of step (b) and in the second plurality of multivalent molecules of step (e) comprise (i) a core; and (ii) a plurality of nucleotide arms which comprise a core attachment moiety, a spacer, a linker, and a nucleotide unit, wherein the core is attached to the plurality of nucleotide arms via their core attachment moiety, wherein the spacer is attached to the linker, wherein the linker is attached to the nucleotide unit.

In some embodiments, a nucleotide unit of an individual multivalent molecule of step (b) binds a first polymerase which is bound to a nucleic acid duplex comprising an immobilized concatemer template molecule hybridized to a forward sequencing primer. In some embodiments, a nucleotide unit of an individual multivalent molecule of step (e) binds a second polymerase which is bound to a nucleic acid duplex comprising a retained forward extension strand hybridized to a reverse sequencing primer.

In some embodiments, the core comprises streptavidin and the core attachment moiety comprises biotin. In some embodiments, in the spacer comprises a polyethylene glycol (PEG) moiety. In some embodiments, the linker comprises an aliphatic chain having 2-6 subunits or an oligo ethylene glycol chain having 2-6 subunits.

In some embodiments, the plurality of nucleotide arms attached to the core have the same type of a nucleotide unit, and wherein the types of nucleotide unit is selected from a group consisting of dATP, dGTP, dCTP, dTTP and dUTP. In some embodiments, the first plurality of multivalent molecules of step (b) and the second plurality of multivalent molecules of step (e) comprise one type of a multivalent molecule wherein each multivalent molecule in the plurality has the same type of nucleotide unit selected from a group consisting of dATP, dGTP, dCTP, dTTP and dUTP.

In some embodiments, the first plurality of multivalent molecules of step (b) and the second plurality of multivalent molecules of step (e) comprises a mixture of any combination of two or more types of multivalent molecules each type having nucleotide units selected from a group consisting of dATP, dGTP, dCTP, dTTP and/or dUTP. In some embodiments, at least one multivalent molecule in the first plurality of multivalent molecules of step (b) is labeled with a fluorophore, and wherein at least one multivalent molecule in the second plurality of multivalent molecules of step (e) is labeled with a fluorophore. In some embodiments, individual multivalent molecules are attached to a fluorophore that corresponds to the nucleotide units that are attached to the nucleotide arms of a given multivalent molecule.

In some embodiments, the sequencing of step (b), comprises: a) contacting the first plurality of sequencing polymerases to (i) the plurality of immobilized concatemer template molecules and (ii) the plurality of soluble forward sequencing primers, wherein the contacting is conducted under a condition suitable to form a plurality of first complexed polymerases each comprising a first sequencing polymerase bound to a nucleic acid duplex which comprises an immobilized concatemer template molecule hybridized to a soluble forward sequencing primer; b) contacting the plurality of first complexed polymerases with a plurality of fluorophore-labeled multivalent molecules to form a plurality of binding complexes, wherein the contacting is conducted under a condition suitable for binding complementary nucleotide units of the multivalent molecules to at least two of the plurality of first complexed polymerases thereby forming a plurality of binding complexes, and the condition inhibits incorporation of the complementary nucleotide units into the forward sequencing primers; c) detecting the plurality of binding complexes; and d) identifying the nucleobase of the complementary nucleotide units that are bound to the plurality of first complexed polymerases, thereby determining the sequence of the immobilized concatemer template molecules.

In some embodiments, individual binding complexes in the plurality comprise a first sequencing polymerase bound to a multivalent molecule, wherein the binding complexes exhibit a persistence time of greater than 0.5 seconds.

In some embodiments, the method further comprises: forming at least one avidity complex in step (b), the method comprising: a) binding a first soluble forward sequencing primer, a first forward sequencing polymerase, and a first multivalent molecule to a first portion of a first concatemer template molecule thereby forming a first binding complex, wherein a first nucleotide unit of the first multivalent molecule binds to the first sequencing polymerase; and b) binding a second forward sequencing primer, a second forward sequencing polymerase, and the first multivalent molecule to a second portion of the same first concatemer template molecule thereby forming a second binding complex, wherein a second nucleotide unit of the second multivalent molecule binds to the second sequencing polymerase, and wherein the first and second binding complexes which include the same multivalent molecule forms an avidity complex.

In some embodiments, the plurality of immobilized concatemer template molecules comprise at least one nucleotide having a scissile moiety that can be cleaved to generate an abasic site in the concatemer template molecule, wherein the at least one nucleotide having a scissile moiety in the immobilized concatemer template molecules which comprises uridine, 8-oxo-7,8-dihydrogunine, or deoxyinosine. In some embodiments, the plurality of immobilized concatemer template molecules lack a nucleotide having a scissile moiety that can be cleaved to generate an abasic site in the concatemer template molecule, wherein the immobilized concatemer template molecules lack a nucleotide having a scissile moiety which comprises uridine, 8-oxo-7,8-dihydrogunine, or deoxyinosine.

In some embodiments, individual concatemer template molecules in the plurality are covalently joined to the immobilized surface primer. In some embodiments, individual concatemer template molecules in the plurality are hybridized to the immobilized surface primer. In some embodiments, individual concatemer molecules in the plurality are immobilized to a surface primer which is immobilized to the support, wherein the immobilized surface primer lacks a nucleotide having a scissile moiety, and wherein the nucleotide having a scissile moiety comprises uridine, 8-oxo-7,8-dihydrogunine, or deoxyinosine.

The present disclosure also provides a method for pairwise sequencing, comprising: a) providing a plurality of immobilized single stranded nucleic acid concatemer template molecules each comprising at least one nucleotide having a scissile moiety that can be cleaved to generate an abasic site in the concatemer template molecule, wherein individual concatemer template molecules in the plurality are immobilized to a surface primer that is immobilized to a support, wherein the immobilized surface primer lacks a nucleotide having a scissile moiety, and wherein the nucleotide having a scissile moiety comprises uridine; b) sequencing the plurality of immobilized concatemer template molecules with a first plurality of sequencing polymerases, a plurality of soluble forward sequencing primers and a first plurality of multivalent molecules, thereby generating a plurality of extended forward sequencing primer strands, wherein individual immobilized concatemer template molecules have two or more extended forward sequencing primer strands hybridized thereon; c) retaining the plurality of immobilized concatemer template molecules and replacing the plurality of extended forward sequencing primer strands with a plurality of forward extension strands that are hybridized to the retained immobilized concatemer template molecules by conducting a primer extension reaction: d) removing the retained immobilized concatemer template molecules by generating abasic sites in the immobilized concatemer template molecules at the nucleotide(s) having the scissile moiety and generating gaps at the abasic sites to generate a plurality of gap-containing concatemer template molecules while retaining the plurality of forward extension strands and retaining the plurality of immobilized surface primers; and e) sequencing the plurality of retained forward extension strands with a second plurality of sequencing polymerases, a plurality of soluble reverse sequencing primers and a second plurality of multivalent molecules, thereby generating a plurality of extended reverse sequencing primer strands, wherein individual retained forward extension strands have two or more extended reverse sequencing primer strands hybridized thereon, wherein individual multivalent molecules in the first plurality of multivalent molecules of step (b) and in the second plurality of multivalent molecules of step (e) comprise (i) a core; and (ii) a plurality of nucleotide arms which comprise a core attachment moiety, a spacer, a linker, and a nucleotide unit, wherein the core is attached to the plurality of nucleotide arms via their core attachment moiety, wherein the spacer is attached to the linker, wherein the linker is attached to the nucleotide unit.

In some embodiments, a nucleotide unit of an individual multivalent molecule of step (b) binds a first polymerase which is bound to a nucleic acid duplex comprising an immobilized concatemer template molecule hybridized to a forward sequencing primer. In some embodiments, a nucleotide unit of an individual multivalent molecule of step (e) binds a second polymerase which is bound to a nucleic acid duplex comprising a retained forward extension strand hybridized to a reverse sequencing primer.

In some embodiments, the core comprises streptavidin and the core attachment moiety comprises biotin. In some embodiments, in the spacer comprises a polyethylene glycol (PEG) moiety, and wherein the linker comprises an aliphatic chain having 2-6 subunits or an oligo ethylene glycol chain having 2-6 subunits.

In some embodiments, the plurality of nucleotide arms attached to the core have the same type of a nucleotide unit, and wherein the types of nucleotide unit is selected from a group consisting of dATP, dGTP, dCTP, dTTP and dUTP.

In some embodiments, the first plurality of multivalent molecules of step (b) and the second plurality of multivalent molecules of step (e) comprises one type of a multivalent molecule wherein each multivalent molecule in the plurality has the same type of nucleotide unit selected from a group consisting of dATP, dGTP, dCTP, dTTP and dUTP. In some embodiments, the first plurality of multivalent molecules of step (b) and the second plurality of multivalent molecules of step (e) comprises a mixture of any combination of two or more types of multivalent molecules each type having nucleotide units selected from a group consisting of dATP, dGTP, dCTP, dTTP and/or dUTP. In some embodiments, at least one multivalent molecule in the first plurality of multivalent molecules of step (b) is labeled with a fluorophore, and wherein at least one multivalent molecule in the second plurality of multivalent molecules of step (e) is labeled with a fluorophore.

In some embodiments, generating the abasic sites at the uridines at step (d) comprises contacting the immobilized concatemer template molecules with uracil DNA glycosylase (UDG). In some embodiments, generating the plurality of gap-containing single stranded nucleic acid concatemer template molecules of step (d) comprises contacting the retained immobilized template molecules containing one or more abasic sites with an endonuclease IV, AP lyase (e.g., DNA-apurinic lyase or DNA-apyrimidinic lyase), FPG glycosylase/AP lyase and/or endo VIII glycosylase/AP lyase.

The present disclosure provides a method for pairwise sequencing, comprising: a) providing a plurality of immobilized single stranded nucleic acid concatemer template molecules each comprising at least one nucleotide having a scissile moiety that can be cleaved to generate an abasic site in the concatemer template molecule, wherein individual concatemer template molecules in the plurality are immobilized to a first surface primer that is immobilized to a support, and wherein the immobilized first surface primer lacks a nucleotide having a scissile moiety; b) sequencing the plurality of immobilized concatemer template molecules thereby generating a plurality of extended forward sequencing primer strands, wherein individual immobilized concatemer template molecules have two or more extended forward sequencing primer strands hybridized thereon; c) retaining the plurality of immobilized concatemer template molecules and replacing the plurality of extended forward sequencing primer strands with a plurality of forward extension strands that are hybridized to the retained immobilized single stranded nucleic acid concatemer template molecules by conducting a primer extension reaction; d) removing the retained immobilized concatemer template molecules by generating abasic sites in the immobilized single stranded concatemer template molecules at the nucleotide(s) having the scissile moiety and generating gaps at the abasic sites to generate a plurality of gap-containing single stranded nucleic acid concatemer template molecules while retaining the plurality of forward extension strands and retaining the plurality of immobilized surface primers; and e) sequencing the plurality of retained forward extension strands thereby generating a plurality of extended reverse sequencing primer strands, wherein individual retained forward extension strands have two or more extended reverse sequencing primer strands hybridized thereon.

In some embodiments, the individual concatemer template molecules in the plurality are covalently joined to an immobilized first surface primer. In some embodiments, the individual concatemer template molecules in the plurality are hybridized to an immobilized first surface primer. In some embodiments, the individual immobilized concatemer template molecules in the plurality comprise two or more copies of a sequence of interest, and wherein the individual immobilized concatemer template molecules further comprise any one or any combination of two or more of (i) two or more copies of a universal binding sequence for a soluble forward sequencing primer, (ii) two or more copies of a universal binding sequence for a soluble reverse sequencing primer, (iii) two or more copies of a universal binding sequence for an immobilized first surface primer, (iv) two or more copies of a universal binding sequence for an immobilized second surface primer, (v) two or more copies of a universal binding sequence for a first soluble amplification primer, (vi) two or more copies of a universal binding sequence for a second soluble amplification primer, (vii) two or more copies of a universal binding sequence for a soluble compaction oligonucleotide, (viii) two or more copies of a sample barcode sequence and/or (ix) two or more copies of a unique molecular index sequence.

In some embodiments, the sequencing of step (b) comprises hybridizing a plurality of soluble forward sequencing primers to the plurality of immobilized concatemer template molecules and conducting one or more sequencing reactions. In some embodiments, the sequencing of step (e) comprises hybridizing a plurality of soluble reverse sequencing primers to the plurality of immobilized concatemer template molecules and conducting one or more sequencing reactions.

In some embodiments, the support further comprises a plurality of immobilized second surface primers that lack a nucleotide having a scissile moiety. In some embodiments, at least one copy of the universal binding sequence for the immobilized second surface primer in the individual concatemer template molecules is hybridized to an immobilized second surface primer. In some embodiments, the plurality of immobilized second surface primers have 3' OH extendible ends. In some embodiments, the plurality of immobilized second surface primers have 3' non-extendible ends. In some embodiments, the 3' non-extendible end comprises a phosphate group, a dideoxycytidine group, an inverted dT, or an amino group.

The present disclosure also provides a method for pairwise sequencing, comprising: a) providing a support having a plurality of a first surface primer immobilized thereon wherein each of the first surface primers have a 3' extendible end and lack a nucleotide having a scissile moiety; b) generating a plurality of immobilized single stranded nucleic acid concatemer template molecules by hybridizing a plurality of single-stranded circular nucleic acid library molecules to the plurality of immobilized first surface primers and conducting a rolling circle amplification reaction with a plurality of a strand displacing polymerase, and a plurality of nucleotides which include dATP, dCTP, dGTP, dTTP and a nucleotide having a scissile moiety that can be cleaved to generate an abasic site, thereby generating a plurality of immobilized single stranded nucleic acid concatemer template molecules having at least one nucleotide with a scissile moiety, wherein individual single stranded nucleic acid concatemer template molecules are covalently joined to an immobilized first surface primer, c) sequencing the plurality of immobilized concatemer template molecules thereby generating a plurality of extended forward sequencing primer strands, wherein individual immobilized concatemer template molecules have two or more extended forward sequencing primer strands hybridized thereon; d) retaining the plurality of immobilized concatemer template molecules and replacing the plurality of extended forward sequencing primer strands with a plurality of forward extension strands that are hybridized to the retained immobilized single stranded nucleic acid concatemer template molecules by conducting a primer extension reaction; e) removing the retained immobilized concatemer template molecules by generating abasic sites in the immobilized single stranded concatemer template molecules at the nucleotide(s) having the scissile moiety and generating gaps at the abasic sites to generate a plurality of gap-containing single stranded nucleic acid concatemer template molecules while retaining the plurality of forward extension strands and retaining the plurality of immobilized first surface primers; and f) sequencing the plurality of retained forward extension strands thereby generating a plurality of extended reverse sequencing primer strands, wherein individual forward extension strands have two or more extended reverse sequencing primer strands hybridized thereon.

In some embodiments, each of the single stranded circular nucleic acid library molecules in the plurality comprises a sequence of interest and wherein the individual library molecules further comprise any one or any combination of two or more of (i) a universal binding sequence for a soluble forward sequencing primer, (ii) a universal binding sequence for a soluble reverse sequencing primer, (iii) a universal binding sequence for an immobilized first surface primer, (iv) a universal binding sequence for an immobilized second surface primer, (v) a universal binding sequence for a first soluble amplification primer, (vi) a universal binding sequence for a second soluble amplification primer, (vii) a universal binding sequence for a soluble compaction oligonucleotide, (viii) a sample barcode sequence and/or (ix) a unique molecular index sequence.

In some embodiments, the individual immobilized single stranded nucleic acid concatemer template molecules generated by the rolling circle amplification reaction comprise two or more copies of a sequence of interest and wherein the individual immobilized concatemer template molecules further comprise any one or any combination of two or more of (i) two or more copies of a universal binding sequence for a soluble forward sequencing primer, (ii) two or more copies of a universal binding sequence for a soluble reverse sequencing primer, (iii) two or more copies of a universal binding sequence for an immobilized first surface primer, (iv) two or more copies of a universal binding sequence for an immobilized second surface primer, (v) two or more copies of a universal binding sequence for a first soluble amplification primer, (vi) two or more copies of a universal binding sequence for a second soluble amplification primer, (vii) two or more copies of a universal binding sequence for a soluble compaction oligonucleotide, (viii) two or more copies of a sample barcode sequence and/or (ix) two or more copies of a unique molecular index sequence.

In some embodiments, the sequencing of step (c) comprises hybridizing a plurality of soluble forward sequencing primers to the plurality of immobilized concatemer template molecules and conducting one or more sequencing reactions. In some embodiments, the sequencing of step (f) comprises hybridizing a plurality of soluble reverse sequencing primers to the plurality of immobilized concatemer template molecules and conducting one or more sequencing reactions.

In some embodiments, the support further comprises a plurality of immobilized second surface primers that lack a nucleotide having a scissile moiety. In some embodiments, at least one copy of the universal binding sequence for the immobilized second surface primer in the individual concatemer template molecules is hybridized to an immobilized second surface primer. In some embodiments, the plurality of immobilized second surface primers have 3' OH extendible ends. In some embodiments, the plurality of immobilized second surface primers have 3' non-extendible ends. In some embodiments, the 3' non-extendible end comprises a phosphate group, a dideoxycytidine group, an inverted dT, or an amino group.

The present disclosure also provides a method for pairwise sequencing, comprising: a) contacting in-solution a plurality of single-stranded circular nucleic acid library molecules to a plurality of first soluble amplification primers, a plurality of a strand displacing polymerase, and a plurality of nucleotides which include dATP, dCTP, dGTP, dTTP and a nucleotide having a scissile moiety that can be cleaved to generate an abasic site, under a condition suitable to form a plurality of library-primer duplexes and suitable for conducting a rolling circle amplification reaction, thereby generating a plurality of single stranded nucleic acid concatemers having at least one nucleotide with a scissile moiety; b) distributing the rolling circle amplification reaction onto a support having a plurality of the first surface primers immobilized thereon, under a condition suitable for hybridizing one or more portions of individual single stranded concatemers to one or more immobilized first surface primers, wherein each of the first surface primers lack a nucleotide having a scissile moiety; c) continuing the rolling circle amplification reaction on the support to generate a plurality of immobilized concatemer template molecules; d) sequencing the plurality of immobilized concatemer template molecules thereby generating a plurality of extended forward sequencing primer strands wherein individual immobilized concatemer template molecules have two or more extended forward sequencing primer strands hybridized thereon; e) retaining the plurality of immobilized concatemer template molecules and replacing the plurality of extended forward sequencing primer strands with a plurality of forward extension strands that are hybridized to the retained immobilized single stranded nucleic acid concatemer template molecules by conducting a primer extension reaction; f) removing the retained immobilized concatemer template molecules by generating abasic sites in the immobilized single stranded concatemer template molecules at the nucleotide(s) having the scissile moiety and generating gaps at the abasic sites to generate a plurality of gap-containing single stranded nucleic acid concatemer template molecules while retaining the plurality of forward extension strands and retaining the plurality of immobilized first surface primers; and g) sequencing the plurality of retained forward extension strands thereby generating a plurality of extended reverse sequencing primer strands wherein individual forward extension strands have two or more extended reverse sequencing primer strands hybridized thereon.

In some embodiments, each of the single stranded circular nucleic acid library molecules in the plurality comprises a sequence of interest and wherein the individual library molecules further comprise any one or any combination of two or more of (i) a universal binding sequence for a soluble forward sequencing primer, (ii) a universal binding sequence for a soluble reverse sequencing primer, (iii) a universal binding sequence for an immobilized first surface primer, (iv) a universal binding sequence for an immobilized second surface primer, (v) a universal binding sequence for a first soluble amplification primer, (vi) a universal binding sequence for a second soluble amplification primer, (vii) a universal binding sequence for a soluble compaction oligonucleotide, (viii) a sample barcode sequence and/or (ix) a unique molecular index sequence.

In some embodiments, individual immobilized single stranded nucleic acid concatemer template molecules generated by the rolling circle amplification reaction comprise two or more copies of a sequence of interest and wherein the individual immobilized concatemer template molecules further comprise any one or any combination of two or more of (i) two or more copies of a universal binding sequence for a soluble forward sequencing primer, (ii) two or more copies of a universal binding sequence for a soluble reverse sequencing primer, (iii) two or more copies of a universal binding sequence for an immobilized first surface primer, (iv) two or more copies of a universal binding sequence for an immobilized second surface primer, (v) two or more copies of a universal binding sequence for a first soluble amplification primer, (vi) two or more copies of a universal binding sequence for a second soluble amplification primer, (vii) two or more copies of a universal binding sequence for a soluble compaction oligonucleotide, (viii) two or more copies of a sample barcode sequence and/or (ix) two or more copies of a unique molecular index sequence.

In some embodiments, the sequencing of step (d) comprises hybridizing a plurality of soluble forward sequencing primers to the plurality of immobilized concatemer template molecules and conducting one or more sequencing reactions. In some embodiments, the sequencing of step (g) comprises hybridizing a plurality of soluble reverse sequencing primers to the plurality of immobilized concatemer template molecules and conducting one or more sequencing reactions.

In some embodiments, the support further comprises a plurality of immobilized second surface primers that lack a nucleotide having a scissile moiety. In some embodiments, at least one copy of the universal binding sequence for the immobilized second surface primer in the individual concatemer template molecules is hybridized to an immobilized second surface primer. In some embodiments, the plurality of immobilized second surface primers have 3' OH extendible ends. In some embodiments, the plurality of immobilized second surface primers have 3' non-extendible ends. In some embodiments, the 3' non-extendible end comprises a phosphate group, a dideoxycytidine group, an inverted dT, or an amino group.

The present disclosure provides a method for pairwise sequencing, comprising: a) providing a support having a plurality of a first surface primer immobilized thereon wherein individual first surface primers in the plurality comprise a first portion (SP1-A) and a second portion (SP1-B), and the individual first surface primers comprising a 3' extendible end and lacking a nucleotide having a scissile moiety that can be cleaved to generate an abasic site in the first surface primer; b) contacting the plurality of the first surface primers with a plurality of single stranded linear nucleic acid library molecules, each library molecule having at the 5' end a universal sequence (SP1-A') that binds the first portion of the immobilized first surface primer, and the library molecules each having at the 3' end a universal sequence (SP1-B') that binds the second portion of the immobilized first surface primer, wherein the contacting is conducted under a condition suitable for hybridizing individual library molecules to an immobilized first surface primer to form a circularized library molecule having a gap or nick between the 5' and 3' ends of the circularized library molecule; c) enzymatically closing the gap or nick thereby forming individual covalently closed circular molecules that are hybridized to an immobilized first surface primer; d) generating a plurality of immobilized single stranded nucleic acid concatemer template molecules by conducting a rolling circle amplification reaction with a plurality of a strand displacing polymerase, and a plurality of nucleotides which include dATP, dCTP, dGTP, dTTP and a nucleotide having a scissile moiety that can be cleaved to generate an abasic site, thereby generating a plurality of immobilized single stranded nucleic acid concatemer template molecules having at least one nucleotide with a scissile moiety, wherein individual single stranded nucleic acid concatemer template molecules are covalently joined to an immobilized first surface primer; e) sequencing the plurality of immobilized concatemer template molecules thereby generating a plurality of extended forward sequencing primer strands, wherein individual immobilized concatemer template molecules have two or more extended forward sequencing primer strands hybridized thereon; f) retaining the plurality of immobilized concatemer template molecules and replacing the plurality of extended forward sequencing primer strands with a plurality of forward extension strands that are hybridized to the retained immobilized single stranded nucleic acid concatemer template molecules by conducting a primer extension reaction; g) removing the retained immobilized concatemer template molecules by generating abasic sites in the immobilized single stranded concatemer template molecules at the nucleotide(s) having the scissile moiety and generating gaps at the abasic sites to generate a plurality of gap-containing single stranded nucleic acid concatemer template molecules while retaining the plurality of forward extension strands and retaining the plurality of immobilized first surface primers; and h) sequencing the plurality of retained forward extension strands thereby generating a plurality of extended reverse sequencing primer strands, wherein individual forward extension strands have two or more extended reverse sequencing primer strands hybridized thereon.

In some embodiments, individual linear library molecules in the plurality comprise a sequence of interest and the library molecules further comprise any one or any combination of two or more of: (i) a universal binding sequence for a soluble forward sequencing primer, (ii) a universal binding sequence for a soluble reverse sequencing primer, (iii) a universal binding sequence for a first portion of an immobilized first surface primer (SP1-A), (iv) a universal binding sequence for a second portion of an immobilized first surface primer (SP1-B), (v) a universal binding sequence for an immobilized second surface primer, (vi) a universal binding sequence for a first soluble amplification primer, (vii) a universal binding sequence for a second soluble amplification primer, (viii) a universal binding sequence for a soluble compaction oligonucleotide, (ix) a sample barcode sequence and/or (x) a unique molecular index sequence.

In some embodiments, individual immobilized single stranded nucleic acid concatemer template molecules generated by the rolling circle amplification reaction comprise two or more copies of a sequence of interest and wherein the individual immobilized concatemer template molecules further comprise any one or any combination of two or more of (i) two or more copies of a universal binding sequence for a soluble forward sequencing primer, (ii) two or more copies of a universal binding sequence for a soluble reverse sequencing primer, (iii) two or more copies of a universal binding sequence for a first portion of an immobilized first surface primer (SP1-A), (iv) two or more copies of a universal binding sequence for a second portion of an immobilized first surface primer (SP1-B), (v) two or more copies of a universal binding sequence for an immobilized second surface primer, (vi) two or more copies of a universal binding sequence for a first soluble amplification primer, (vii) two or more copies of a universal binding sequence for a second soluble amplification primer, (viii) two or more copies of a universal binding sequence for a soluble compaction oligonucleotide, (ix) two or more copies of a sample barcode sequence and/or (x) two or more copies of a unique molecular index sequence.

In some embodiments, the sequencing of step (e) comprises hybridizing a plurality of soluble forward sequencing primers to the plurality of immobilized concatemer template molecules and conducting one or more sequencing reactions. In some embodiments, the sequencing of step (h) comprises hybridizing a plurality of soluble reverse sequencing primers to the plurality of immobilized concatemer template molecules and conducting one or more sequencing reactions.

In some embodiments, the support further comprises a plurality of immobilized second surface primers that lack a nucleotide having a scissile moiety. In some embodiments, at least one copy of the universal binding sequence for the immobilized second surface primer in the individual concatemer template molecules is hybridized to an immobilized second surface primer. In some embodiments, the plurality of immobilized second surface primers have 3' OH extendible ends. In some embodiments, the plurality of immobilized second surface primers have 3' non-extendible ends. In some embodiments, the 3' non-extendible end comprises a phosphate group, a dideoxycytidine group, an inverted dT, or an amino group.

In some embodiments, the closing the gap in the circularized library molecule comprises conducting a polymerase-catalyzed gap fill-in reaction using the immobilized first surface primer as a template molecule, and ligating the nick to form a covalently closed circular molecule, wherein individual covalently closed circular molecules are hybridized to an immobilized first surface primer. In some embodiments, the closing the nick in the circularized library molecule comprises conducting a ligation reaction to form a covalently closed circular molecule, and wherein individual covalently closed circular molecules are hybridized to an immobilized first surface primer.

The present disclosure provides a method for pairwise sequencing, comprising: a) providing a plurality of immobilized single stranded nucleic acid concatemer template molecules each lacking a scissile moiety that can be cleaved to generate an abasic site in the concatemer template molecule, wherein individual concatemer template molecules in the plurality are immobilized to a first surface primer that is immobilized to a support, and wherein the immobilized first surface primer lacks a nucleotide having a scissile moiety; b) sequencing the plurality of immobilized concatemer template molecules thereby generating a plurality of extended forward sequencing primer strands, wherein individual immobilized concatemer template molecules have two or more extended forward sequencing primer strands hybridized thereon; c) retaining the plurality of immobilized concatemer template molecules and replacing the plurality of extended forward sequencing primer strands with a plurality of forward extension strands by conducting a primer extension reaction with a plurality of soluble amplification primers and a plurality of strand-displacing polymerases to generate a plurality of forward extension strands and a plurality of partially displaced forward extension strands that are hybridized to the immobilized concatemer template molecules to form a plurality of immobilized amplicons, and the primer extension reaction generates a plurality of detached forward extension strands (e.g., that are not hybridized to the immobilized concatemer template molecules); and d) sequencing the plurality of immobilized partially displaced forward extension strands thereby generating a first plurality of extended reverse sequencing primer strands, and sequencing the plurality of immobilized detached forward extension strands thereby generating a second plurality of extended reverse sequencing primer strands, wherein individual immobilized partially displaced forward extension strands have two or more extended reverse sequencing primer strands hybridized thereon, and wherein in individual immobilized detached forward extension strands have two or more extended reverse sequencing primer strands hybridized thereon.

In some embodiments, individual concatemer template molecules in the plurality are covalently joined to an immobilized first surface primer. In some embodiments, individual concatemer template molecules in the plurality are hybridized to an immobilized first surface primer. In some embodiments, individual immobilized concatemer template molecules in the plurality comprise two or more copies of a sequence of interest, and wherein the individual immobilized concatemer template molecules further comprise any one or any combination of two or more of (i) two or more copies of a universal binding sequence for a soluble forward sequencing primer, (ii) two or more copies of a universal binding sequence for a soluble reverse sequencing primer, (iii) two or more copies of a universal binding sequence for an immobilized first surface primer, (iv) two or more copies of a universal binding sequence for an immobilized second surface primer, (v) two or more copies of a universal binding sequence for a first soluble amplification primer, (vi) two or more copies of a universal binding sequence for a second soluble amplification primer, (vii) two or more copies of a universal binding sequence for a soluble compaction oligonucleotide, (viii) two or more copies of a sample barcode sequence and/or (ix) two or more copies of a unique molecular index sequence.

In some embodiments, the sequencing of step (b) comprises hybridizing a plurality of soluble forward sequencing primers to the plurality of immobilized concatemer template molecules and conducting one or more sequencing reactions. In some embodiments, the sequencing of step (d) comprises hybridizing a plurality of soluble reverse sequencing primers to the plurality of immobilized partially displaced forward extension strands and the plurality of immobilized detached extended forward sequencing primer strands, and conducting one or more sequencing reactions.

In some embodiments, the support further comprises a plurality of immobilized second surface primers that lack a nucleotide having a scissile moiety. In some embodiments, at least one copy of the universal binding sequence for the immobilized second surface primer in the individual concatemer template molecules is hybridized to an immobilized second surface primer. In some embodiments, the plurality of immobilized second surface primers have 3' OH extendible ends. In some embodiments, the plurality of immobilized second surface primers have 3' non-extendible ends. In some embodiments, the 3' non-extendible end comprises a phosphate group, a dideoxycytidine group, an inverted dT, or an amino group.

The present disclosure also provides a method for pairwise sequencing, comprising: a) providing a support having a plurality of a first surface primer immobilized thereon wherein each of the first surface primers have a 3' extendible end and lack a nucleotide having a scissile moiety; b) generating a plurality of immobilized single stranded nucleic acid concatemer template molecules by hybridizing a plurality of single-stranded circular nucleic acid library molecules to the plurality of immobilized first surface primers and conducting a rolling circle amplification reaction with a plurality of a strand displacing polymerase, and a plurality of nucleotides which lack a nucleotide having a scissile moiety that can be cleaved to generate an abasic site, thereby generating a plurality of immobilized single stranded nucleic acid concatemer template molecules, wherein individual single stranded nucleic acid concatemer template molecules are covalently joined to an immobilized first surface primer; c) sequencing the plurality of immobilized concatemer template molecules thereby generating a plurality of extended forward sequencing primer strands, wherein individual immobilized concatemer template molecules have two or more extended forward sequencing primer strands hybridized thereon; d) retaining the plurality of immobilized concatemer template molecules and replacing the plurality of extended forward sequencing primer strands with a plurality of forward extension strands by conducting a primer extension reaction with a plurality of soluble amplification primers and a plurality of strand-displacing polymerases to generate a plurality of forward extension strands and a plurality of partially displaced forward extension strands that are hybridized to the immobilized concatemer template molecules to form a plurality of immobilized amplicons, and the primer extension reaction generates a plurality of detached forward extension strands (e.g., that are not hybridized to the immobilized concatemer template molecules); and e) sequencing the plurality of immobilized partially displaced forward extension strands thereby generating a first plurality of extended reverse sequencing primer strands, and sequencing the plurality of immobilized detached forward extension strands thereby generating a second plurality of extended reverse sequencing primer strands, wherein individual immobilized partially displaced forward extension strands have two or more extended reverse sequencing primer strands hybridized thereon, and wherein in individual immobilized detached forward extension strands have two or more extended reverse sequencing primer strands hybridized thereon.

In some embodiments, each of the single stranded circular nucleic acid library molecules in the plurality comprises a sequence of interest, and wherein the individual library molecules further comprise any one or any combination of two or more of (i) a universal binding sequence for a soluble forward sequencing primer, (ii) a universal binding sequence for a soluble reverse sequencing primer, (iii) a universal binding sequence for an immobilized first surface primer, (iv) a universal binding sequence for an immobilized second surface primer, (v) a universal binding sequence for a first soluble amplification primer, (vi) a universal binding sequence for a second soluble amplification primer, (vii) a universal binding sequence for a soluble compaction oligonucleotide, (viii) a sample barcode sequence and/or (ix) a unique molecular index sequence.

In some embodiments, individual immobilized single stranded nucleic acid concatemer template molecules generated by the rolling circle amplification reaction comprise two or more copies of a sequence of interest, wherein the individual immobilized concatemer template molecules further comprise any one or any combination of two or more of (i) two or more copies of a universal binding sequence for a soluble forward sequencing primer, (ii) two or more copies of a universal binding sequence for a soluble reverse sequencing primer, (iii) two or more copies of a universal binding sequence for an immobilized first surface primer, (iv) two or more copies of a universal binding sequence for an immobilized second surface primer, (v) two or more copies of a universal binding sequence for a first soluble amplification primer, (vi) two or more copies of a universal binding sequence for a second soluble amplification primer, (vii) two or more copies of a universal binding sequence for a soluble compaction oligonucleotide, (viii) two or more copies of a sample barcode sequence and/or (ix) two or more copies of a unique molecular index sequence.

In some embodiments, the sequencing of step (c) comprises hybridizing a plurality of soluble forward sequencing primers to the plurality of immobilized concatemer template molecules and conducting one or more sequencing reactions. In some embodiments, the sequencing of step (e) comprises hybridizing a plurality of soluble reverse sequencing primers to the plurality of immobilized partially displaced forward extension strands and the plurality of immobilized detached extended forward sequencing primer strands, and conducting one or more sequencing reactions.

In some embodiments, the support further comprises a plurality of immobilized second surface primers that lack a nucleotide having a scissile moiety. In some embodiments, the at least one copy of the universal binding sequence for the immobilized second surface primer in the individual concatemer template molecules is hybridized to an immobilized second surface primer. In some embodiments, the plurality of immobilized second surface primers have 3' OH extendible ends. In some embodiments, the plurality of immobilized second surface primers have 3' non-extendible ends. In some embodiments, the 3' non-extendible end comprises a phosphate group, a dideoxycytidine group, an inverted dT, or an amino group.

The present disclosure also provides a method for pairwise sequencing, comprising: a) contacting in-solution a plurality of single-stranded circular nucleic acid library molecules to a plurality of first soluble amplification primers, a plurality of a strand displacing polymerase, and a plurality of nucleotides which lacks a nucleotide having a scissile moiety that can be cleaved to generate an abasic site, under a condition suitable to form a plurality of library-primer duplexes and suitable for conducting a rolling circle amplification reaction, thereby generating a plurality of single stranded nucleic acid concatemers; b) distributing the rolling circle amplification reaction onto a support having a plurality of the first surface primers immobilized thereon, under a condition suitable for hybridizing one or more portions of individual single stranded concatemers to one or more immobilized first surface primers, wherein each of the first surface primers lack a nucleotide having a scissile moiety; c) continuing the rolling circle amplification reaction on the support to generate a plurality of immobilized concatemer template molecules; d) sequencing the plurality of immobilized concatemer template molecules thereby generating a plurality of extended forward sequencing primer strands wherein individual immobilized concatemer template molecules have two or more extended forward sequencing primer strands hybridized thereon; e) retaining the plurality of immobilized concatemer template molecules and replacing the plurality of extended forward sequencing primer strands with a plurality of forward extension strands by conducting a primer extension reaction with a plurality of a second soluble amplification primer and a plurality of strand-displacing polymerases to generate a plurality of forward extension strands and a plurality of partially displaced forward extension strands that are hybridized to the immobilized concatemer template molecules to form a plurality of immobilized amplicons, and the primer extension reaction generates a plurality of detached forward extension strands (e.g., that are not hybridized to the immobilized concatemer template molecules); and f) sequencing the plurality of immobilized partially displaced forward extension strands thereby generating a first plurality of extended reverse sequencing primer strands, and sequencing the plurality of immobilized detached forward extension strands thereby generating a second plurality of extended reverse sequencing primer strands, wherein individual immobilized partially displaced forward extension strands have two or more extended reverse sequencing primer strands hybridized thereon, and wherein in individual immobilized detached forward extension strands have two or more extended reverse sequencing primer strands hybridized thereon.

In some embodiments, each of the single stranded circular nucleic acid library molecules in the plurality comprises a sequence of interest, and wherein the individual library molecules further comprise any one or any combination of two or more of (i) a universal binding sequence for a soluble forward sequencing primer, (ii) a universal binding sequence for a soluble reverse sequencing primer, (iii) a universal binding sequence for an immobilized first surface primer, (iv) a universal binding sequence for an immobilized second surface primer, (v) a universal binding sequence for a first soluble amplification primer, (vi) a universal binding sequence for a second soluble amplification primer, (vii) a universal binding sequence for a soluble compaction oligonucleotide, (viii) a sample barcode sequence and/or (ix) a unique molecular index sequence.

In some embodiments, individual immobilized single stranded nucleic acid concatemer template molecules generated by the rolling circle amplification reaction comprise two or more copies of a sequence of interest, and wherein the individual immobilized concatemer template molecules further comprise any one or any combination of two or more of (i) two or more copies of a universal binding sequence for a soluble forward sequencing primer, (ii) two or more copies of a universal binding sequence for a soluble reverse sequencing primer, (iii) two or more copies of a universal binding sequence for an immobilized first surface primer, (iv) two or more copies of a universal binding sequence for an immobilized second surface primer, (v) two or more copies of a universal binding sequence for a first soluble amplification primer, (vi) two or more copies of a universal binding sequence for a second soluble amplification primer, (vii) two or more copies of a universal binding sequence for a soluble compaction oligonucleotide, (viii) two or more copies of a sample barcode sequence and/or (ix) two or more copies of a unique molecular index sequence.

In some embodiments, the sequencing of step (d) comprises hybridizing a plurality of soluble forward sequencing primers to the plurality of immobilized concatemer template molecules and conducting one or more sequencing reactions. In some embodiments, the sequencing of step (f) comprises hybridizing a plurality of soluble reverse sequencing primers to the plurality of immobilized partially displaced forward extension strands and the plurality of immobilized detached extended forward sequencing primer strands, and conducting one or more sequencing reactions.

In some embodiments, the support further comprises a plurality of immobilized second surface primers that lack a nucleotide having a scissile moiety. In some embodiments, at least one copy of the universal binding sequence for the immobilized second surface primer in the individual concatemer template molecules is hybridized to an immobilized second surface primer. In some embodiments, the plurality of immobilized second surface primers have 3' OH extendible ends. In some embodiments, the plurality of immobilized second surface primers have 3' non-extendible ends. In some embodiments, the 3' non-extendible end comprises a phosphate group, a dideoxycytidine group, an inverted dT, or an amino group.

The present disclosure also provides a method for pairwise sequencing, comprising: a) providing a plurality of immobilized single stranded nucleic acid concatemer template molecules each comprising at least one nucleotide having a scissile moiety that can be cleaved to generate an abasic site in the concatemer template molecule, wherein individual concatemer template molecules in the plurality are immobilized to a first surface primer that is immobilized to a support, wherein the immobilized first surface primers include a nucleotide having a scissile moiety, wherein the support further comprises a plurality of immobilized second surface primers which lack a nucleotide having a scissile moiety and have an extendible terminal 3'OH group, and wherein the immobilized concatemer template molecule comprises two or more copies of a universal binding sequence for an immobilized second surface primer (wherein the support comprises an excess of immobilized first and second surface primers compared to the number of immobilized concatemer template molecules); b) sequencing the plurality of immobilized concatemer template molecules with a plurality of soluble forward sequencing primers thereby generating a plurality of extended forward sequencing primer strands, wherein individual immobilized concatemer template molecules have two or more extended forward sequencing primer strands hybridized thereon; c) removing the extended forward sequencing primer strands and retaining the immobilized concatemer template molecules; d) generating a first plurality of immobilized forward extension strands by hybridizing at least one portion of individual immobilized concatemer template molecules to a second surface primer and conducting a primer extension reaction from the second surface primers that are hybridized to a portion of the immobilized concatemer template molecule to generate a plurality of forward extension strands having a sequence that is complementary to at least a portion of the immobilized concatemer template molecules and are covalently joined to an immobilized second surface primer; e) contacting the plurality of immobilized concatemer template molecules and the plurality of immobilized forward extension strands with a relaxing solution which comprises at least one chaotropic agent; f) dissociating the at least one portion of the immobilized concatemer template molecules from the immobilized second surface primers and retaining the immobilized forward extension strands, and re-hybridizing at least one portion of the immobilized concatemer template molecules to one of the immobilized second surface primers that are not covalently joined to a forward extension strand, wherein the dissociating and re-associating comprises a temperature ramp-up, a temperature plateau, and temperature ramp-down, and washing the relaxing solution from the support; g) contacting the re-hybridized immobilized concatemer template molecules with an amplification solution and conducting a primer extension reaction from the second surface primers that are re-hybridized to a portion of the immobilized concatemer template molecules to generate a plurality of newly synthesized forward extension strands having a sequence that is complementary to at least a portion of the immobilized concatemer template molecules and are covalently joined to an immobilized second surface primer; h) repeating steps (e)-(g) at least once; i) removing the retained immobilized concatemer template molecules by generating abasic sites in the immobilized single stranded concatemer template molecules and the immobilized first surface primers at the nucleotide(s)

having the scissile moiety and generating gaps at the abasic sites thereby generating a plurality of gap-containing nucleic acid molecules while retaining the plurality of immobilized forward extension strands and retaining the plurality of immobilized second surface primers; and j) sequencing the plurality of retained immobilized forward extension strands with a plurality of soluble reverse sequencing primers thereby generating a plurality of extended reverse sequencing primer strands.

In some embodiments, individual concatemer template molecules in the plurality are covalently joined to an immobilized first surface primer. In some embodiments, individual concatemer template molecules in the plurality are hybridized to an immobilized first surface primer. In some embodiments, individual immobilized concatemer template molecules in the plurality comprise two or more copies of a sequence of interest, and wherein the individual immobilized concatemer template molecules further comprise any one or any combination of two or more of (i) two or more copies of a universal binding sequence for a soluble forward sequencing primer, (ii) two or more copies of a universal binding sequence for a soluble reverse sequencing primer, (iii) two or more copies of a universal binding sequence for an immobilized first surface primer, (iv) two or more copies of a universal binding sequence for an immobilized second surface primer, (v) two or more copies of a universal binding sequence for a first soluble amplification primer, (vi) two or more copies of a universal binding sequence for a second soluble amplification primer, (vii) two or more copies of a universal binding sequence for a soluble compaction oligonucleotide, (viii) two or more copies of a sample barcode sequence and/or (ix) two or more copies of a unique molecular index sequence.

The present disclosure also provides a method for pairwise sequencing, comprising: a) providing a support having a plurality of first and second surface primers immobilized thereon, wherein the first surface primers have a scissile moiety that can be cleaved to generate an abasic site, and wherein the second surface primers lack a nucleotide having a scissile moiety and the second surface primers have an extendible terminal 3'OH group; b) generating a plurality of immobilized single stranded nucleic acid concatemer template molecules by hybridizing a plurality of single-stranded circular nucleic acid library molecules to the plurality of immobilized first surface primers and conducting a rolling circle amplification reaction with a plurality of a strand displacing polymerase, and a plurality of nucleotides which include dATP, dCTP, dGTP, dTTP and a plurality of nucleotides having a scissile moiety that can be cleaved to generate an abasic site, thereby generating a plurality of immobilized single stranded nucleic acid concatemer template molecules having at least one nucleotide with a scissile moiety, wherein individual single stranded nucleic acid concatemer template molecules are covalently joined to an immobilized first surface primer; c) sequencing the plurality of immobilized concatemer template molecules with a plurality of soluble forward sequencing primers thereby generating a plurality of extended forward sequencing primer strands, wherein individual immobilized concatemer template molecules have two or more extended forward sequencing primer strands hybridized thereon; d) removing the extended forward sequencing primer strands and retaining the immobilized concatemer template molecules; e) generating a first plurality of immobilized forward extension strands by hybridizing at least one portion of individual immobilized concatemer template molecules to a second surface primer and conducting a primer extension reaction from the second surface primers that are hybridized to a portion of the immobilized concatemer template molecule to generate a plurality of forward extension strands having a sequence that is complementary to at least a portion of the immobilized concatemer template molecules and are covalently joined to an immobilized second surface primer; f) contacting the plurality of immobilized concatemer template molecules and the plurality of immobilized forward extension strands with a relaxing solution which comprises at least one chaotropic agent; g) dissociating the at least one portion of the immobilized concatemer template molecules from the immobilized second surface primers and retaining the immobilized forward extension strands, and re-hybridizing at least one portion of the immobilized concatemer template molecules to one of the immobilized second surface primers that are not covalently joined to a forward extension strand, wherein the dissociating and re-associating comprises a temperature ramp-up, a temperature plateau, and temperature ramp-down, and washing the relaxing solution from the support; h) contacting the re-hybridized immobilized concatemer template molecules with an amplification solution and conducting a primer extension reaction from the second surface primers that are re-hybridized to a portion of the immobilized concatemer template molecules to generate a plurality of newly synthesized forward extension strands having a sequence that is complementary to at least a portion of the immobilized concatemer template molecules and are covalently joined to an immobilized second surface primer; i) repeating steps (f)-(h) at least once; j) removing the retained immobilized concatemer template molecules by generating abasic sites in the immobilized single stranded concatemer template molecules and the immobilized first surface primers at the nucleotide(s) having the scissile moiety and generating gaps at the abasic sites to generate a plurality of gap-containing nucleic acid molecules while retaining the plurality of immobilized forward extension strands and retaining the plurality of immobilized second surface primers; and k) sequencing the plurality of retained immobilized forward extension strands with a plurality of soluble reverse sequencing primers thereby generating a plurality of extended reverse sequencing primer strands.

In some embodiments, each of the single stranded circular nucleic acid library molecules in the plurality comprises a sequence of interest and wherein the individual library molecules further comprise any one or any combination of two or more of (i) a universal binding sequence for a soluble forward sequencing primer, (ii) a universal binding sequence for a soluble reverse sequencing primer, (iii) a universal binding sequence for an immobilized first surface primer, (iv) a universal binding sequence for an immobilized second surface primer, (v) a universal binding sequence for a first soluble amplification primer, (vi) a universal binding sequence for a second soluble amplification primer, (vii) a universal binding sequence for a soluble compaction oligonucleotide, (viii) a sample barcode sequence and/or (ix) a unique molecular index sequence.

In some embodiments, individual immobilized concatemer template molecules in the plurality comprise two or more copies of a sequence of interest, and wherein the individual immobilized concatemer template molecules further comprise any one or any combination of two or more of (i) two or more copies of a universal binding sequence for a soluble forward sequencing primer, (ii) two or more copies of a universal binding sequence for a soluble reverse sequencing primer, (iii) two or more copies of a universal binding sequence for an immobilized first surface primer, (iv) two or more copies of a universal binding sequence for an immobilized second surface primer, (v) two or more copies of a universal binding sequence for a first soluble amplification primer, (vi) two or more copies of a universal binding sequence for a second soluble amplification primer, (vii) two or more copies of a universal binding sequence for a soluble compaction oligonucleotide, (viii) two or more copies of a sample barcode sequence and/or (ix) two or more copies of a unique molecular index sequence.

The present disclosure also provides a method for pairwise sequencing, comprising: a) contacting in-solution a plurality of single-stranded circular nucleic acid library molecules to a plurality of first soluble amplification primers, a plurality of a strand displacing polymerase, and a plurality of nucleotides which include dATP, dCTP, dGTP, dTTP and a plurality of nucleotides having a scissile moiety that can be cleaved to generate an abasic site, under a condition suitable to form a plurality of library-primer duplexes and suitable for conducting a rolling circle amplification reaction, thereby generating a plurality of single stranded nucleic acid concatemers having at least one nucleotide with a scissile moiety; b) distributing the rolling circle amplification reaction onto a support having a plurality of the first surface primers immobilized thereon, under a condition suitable for hybridizing one or more portions of individual single stranded concatemers to one or more immobilized first surface primers, wherein the immobilized first surface primers include a nucleotide having a scissile moiety, wherein the support further comprises a plurality of immobilized second surface primers which lack a nucleotide having a scissile moiety and have an extendible terminal 3'OH group; c) continuing the rolling circle amplification reaction on the support in the presence of a plurality of nucleotides which include a plurality of nucleotides having a scissile moiety to generate a plurality of immobilized concatemer template molecules; d) sequencing the plurality of immobilized concatemer template molecules with a plurality of soluble forward sequencing primers thereby generating a plurality of extended forward sequencing primer strands, wherein individual immobilized concatemer template molecules have two or more extended forward sequencing primer strands hybridized thereon; e) removing the extended forward sequencing primer strands and retaining the immobilized concatemer template molecules; f) generating a first plurality of immobilized forward extension strands by hybridizing at least one portion of individual immobilized concatemer template molecules to a second surface primer and conducting a primer extension reaction from the second surface primers that are hybridized to a portion of the immobilized concatemer template molecule to generate a plurality of forward extension strands having a sequence that is complementary to at least a portion of the immobilized concatemer template molecules and are covalently joined to an immobilized second surface primer; g) contacting the plurality of immobilized concatemer template molecules and the plurality of immobilized forward extension strands with a relaxing solution which comprises at least one chaotropic agent; h) dissociating the at least one portion of the immobilized concatemer template molecules from the immobilized second surface primers and retaining the immobilized forward extension strands, and re-hybridizing at least one portion of the immobilized concatemer template molecules to one of the immobilized second surface primers that are not covalently joined to a forward extension strand, wherein the dissociating and re-associating comprises a temperature ramp-up, a temperature plateau, and temperature ramp-down, and washing the relaxing solution from the support; i) contacting the re-hybridized immobilized concatemer template molecules with an amplification solution and conducting a primer extension reaction from the second surface primers that are re-hybridized to a portion of the immobilized concatemer template molecules to generate a plurality of newly synthesized forward extension strands having a sequence that is complementary to at least a portion of the immobilized concatemer template molecules and are covalently joined to an immobilized second surface primer; j) repeating steps (g)-(i) at least once; k) removing the retained immobilized concatemer template molecules by generating abasic sites in the immobilized single stranded concatemer template molecules and the immobilized first surface primers at the nucleotide(s) having the scissile moiety and generating gaps at the abasic sites to generate a plurality of gap-containing nucleic acid molecules while retaining the plurality of immobilized forward extension strands and retaining the plurality of immobilized second surface primers; and l) sequencing the plurality of retained immobilized forward extension strands with a plurality of soluble reverse sequencing primers thereby generating a plurality of extended reverse sequencing primer strands.

In some embodiments, each of the single stranded circular nucleic acid library molecules in the plurality comprises a sequence of interest and wherein the individual library molecules further comprise any one or any combination of two or more of (i) a universal binding sequence for a soluble forward sequencing primer, (ii) a universal binding sequence for a soluble reverse sequencing primer, (iii) a universal binding sequence for an immobilized first surface primer, (iv) a universal binding sequence for an immobilized second surface primer, (v) a universal binding sequence for a first soluble amplification primer, (vi) a universal binding sequence for a second soluble amplification primer, (vii) a universal binding sequence for a soluble compaction oligonucleotide, (viii) a sample barcode sequence and/or (ix) a unique molecular index sequence.

In some embodiments, individual immobilized concatemer template molecules in the plurality comprise two or more copies of a sequence of interest, and wherein the individual immobilized concatemer template molecules further comprise any one or any combination of two or more of (i) two or more copies of a universal binding sequence for a soluble forward sequencing primer, (ii) two or more copies of a universal binding sequence for a soluble reverse sequencing primer, (iii) two or more copies of a universal binding sequence for an immobilized first surface primer, (iv) two or more copies of a universal binding sequence for an immobilized second surface primer, (v) two or more copies of a universal binding sequence for a first soluble amplification primer, (vi) two or more copies of a universal binding sequence for a second soluble amplification primer, (vii) two or more copies of a universal binding sequence for a soluble compaction oligonucleotide, (viii) two or more copies of a sample barcode sequence and/or (ix) two or more copies of a unique molecular index sequence.

In any of the foregoing or related embodiments, the support comprises a planar substrate which comprises glass, fused-silica, silicon, a polymer (e.g., polystyrene (PS), macroporous polystyrene (MPPS), polymethylmethacrylate (PMMA), polycarbonate (PC), polypropylene (PP), polyethylene (PE), high density polyethylene (HDPE), cyclic olefin polymers (COP), cyclic olefin copolymers (COC), polyethylene terephthalate (PET)), or any combination thereof.

In any of the foregoing or related embodiments, the support comprises at least one hydrophilic polymer coating having a water contact angle of no more than 45 degrees, and wherein at least one of the hydrophilic polymer coatings comprising branched hydrophilic polymer having at least 4 branches.

In any of the foregoing or related embodiments, the 5' end of the plurality of first surface primers are immobilized to the support or immobilized to a coating on the support. In any of the foregoing or related embodiments, the plurality of first surface primers comprise modified oligonucleotide molecules having 2-10 phosphorothioate linkages at their 5' ends to confer resistance to nuclease degradation.

In any of the foregoing or related embodiments, the 5' end of the plurality of second surface primers are immobilized to the support or immobilized to a coating on the support. In some embodiments, the plurality of second surface primers comprise modified oligonucleotide molecules having 2-10 phosphorothioate linkages at their 5' ends to confer resistance to nuclease degradation.

In any of the foregoing or related embodiments, the immobilized concatemer template molecules comprise at least one nucleotide having a scissile moiety which comprises uridine, 8-oxo-7,8-dihydrogunine, or deoxyinosine.

In any of the foregoing or related embodiments, the nucleotides with a scissile moiety are located at randomly distributed positions in individual immobilized concatemer template molecules in the plurality.

In any of the foregoing or related embodiments, 0.01-30% of the thymidine nucleotides in the individual immobilized concatemer template molecules are replaced with uridine. In any of the foregoing or related embodiments, 0.01-30% of the guanosine nucleotides in the individual immobilized concatemer template molecules are replaced with 8-oxo-7, 8-dihydrogunine or deoxyinosine.

In any of the foregoing or related embodiments, the soluble forward sequencing primer comprises a 3' OH extendible end and lacks a nucleotide having a scissile moiety. In any of the foregoing or related embodiments, the soluble reverse sequencing primer comprises a 3' OH extendible end and lacks a nucleotide having a scissile moiety.

In any of the foregoing or related embodiments, the first soluble amplification primer comprises a 3' OH extendible end and lacks a nucleotide having a scissile moiety. In any of the foregoing or related embodiments, the second soluble amplification primer comprises a 3' OH extendible end and lacks a nucleotide having a scissile moiety.

In any of the foregoing or related embodiments, the forward sequencing step comprises: a) contacting a plurality of sequencing polymerases to (i) a plurality of immobilized concatemer template molecules and (ii) a plurality of the soluble forward sequencing primers, wherein the contacting is conducted under a condition suitable to form a plurality of complexed polymerases each comprising a sequencing polymerase bound to a nucleic acid duplex wherein the nucleic acid duplex comprises a immobilized concatemer template molecule hybridized to a soluble forward sequencing primer; b) contacting the plurality of complexed sequencing polymerases with a plurality of nucleotides under a condition suitable for binding at least one nucleotide to a complexed sequencing polymerase, wherein the plurality of nucleotides comprises at least one nucleotide analog labeled with a fluorophore and having a removable chain terminating moiety at the sugar 3' position; c) incorporating at least one nucleotide into the 3' end of the hybridized forward sequencing primers thereby generating a plurality of nascent extended forward sequencing primers; and d) detecting the incorporated nucleotide and identifying the nucleo-base of the incorporated nucleotide.

In any of the foregoing or related embodiments, the reverse sequencing step comprises: a) contacting a plurality of sequencing polymerases to (i) a plurality of the retained forward extension strands and (ii) a plurality of the soluble reverse sequencing primers, wherein the contacting is conducted under a condition suitable to form a plurality of complexed polymerases each comprising a sequencing polymerase bound to a nucleic acid duplex wherein the nucleic acid duplex comprises a retained forward extension strand hybridized to a soluble reverse sequencing primer; b) contacting the plurality of complexed sequencing polymerases with a plurality of nucleotides under a condition suitable for binding at least one nucleotide to a complexed sequencing polymerase, wherein the plurality of nucleotides comprises at least one nucleotide analog labeled with a fluorophore and having a removable chain terminating moiety at the sugar 3' position; c) incorporating at least one nucleotide into the 3' end of the hybridized reverse sequencing primers thereby generating a plurality of nascent extended reverse sequencing primers; and d) detecting the incorporated nucleotide and identifying the nucleo-base of the incorporated nucleotide.

In some embodiments, the reverse sequencing of step (a) comprises hybridizing the plurality of soluble reverse sequencing primers to the plurality of the retained forward extension strands in the presence of a high efficiency hybridization buffer which comprises: (i) a first polar aprotic solvent which comprises acetonitrile at 25-50% by volume of the hybridization buffer; (ii) a second polar aprotic solvent which comprises formamide at 5-10% by volume of the hybridization buffer; (iii) a pH buffering system which comprises 2-(N-morpholino)ethanesulfonic acid (MES) at a pH of 5-6.5; and (iv) a crowding agent which comprises polyethylene glycol (PEG) at 5-35% by volume of the hybridization buffer.

In some embodiments, the reverse sequencing step comprises: a) contacting a plurality of sequencing polymerases to (i) a plurality of the immobilized partially displaced forward extension strands, (ii) a plurality of plurality of immobilized detached extended forward sequencing primer strands, and (iii) a plurality of the soluble reverse sequencing primers, wherein the contacting is conducted under a condition suitable to form a plurality of complexed polymerases each comprising a sequencing polymerase bound to a nucleic acid duplex wherein the nucleic acid duplex comprises a soluble reverse sequencing primer hybridized to an immobilized partially displaced forward extension strand or an immobilized detached extended forward sequencing primer strand; b) contacting the plurality of complexed sequencing polymerases with a plurality of nucleotides under a condition suitable for binding at least one nucleotide to a complexed sequencing polymerase, wherein the plurality of nucleotides comprises at least one nucleotide analog labeled with a fluorophore and having a removable chain terminating moiety at the sugar 3' position; c) incorporating at least one nucleotide into the 3' end of the hybridized reverse sequencing primers thereby generating a plurality of nascent extended reverse sequencing primers; and d) detecting the incorporated nucleotide and identifying the nucleo-base of the incorporated nucleotide.

In some embodiments, the reverse sequencing of step a) comprises hybridizing the plurality of soluble reverse sequencing primers to the plurality of the retained forward extension strands in the presence of a high efficiency hybridization buffer which comprises: (i) a first polar aprotic solvent which comprises acetonitrile at 25-50% by volume of the hybridization buffer; (ii) a second polar aprotic solvent which comprises formamide at 5-10% by volume of the hybridization buffer; (iii) a pH buffering system which comprises 2-(N-morpholino)ethanesulfonic acid (MES) at a pH of 5-6.5; and (iv) a crowding agent which comprises polyethylene glycol (PEG) at 5-35% by volume of the hybridization buffer.

In any of the foregoing or related embodiments, the forward sequencing step and the reverse sequencing step comprises: 1) conducting a sequencing reaction at a position on the template molecule using multivalent molecules which bind but do not incorporate; 2) conducting a sequencing reaction at the same position on the template molecule using nucleotides with incorporation; and 3) repeating steps a) and b) at the next position on the template molecule.

In any of the foregoing or related embodiments, the forward sequencing step and the reverse sequencing step comprises: a) contacting a plurality of a first sequencing polymerase to (i) a plurality of nucleic acid template molecules and (ii) a plurality of soluble sequencing primers, wherein the contacting is conducted under a condition suitable to form a plurality of first complexed polymerases each comprising a first sequencing polymerase bound to a nucleic acid duplex wherein the nucleic acid duplex comprises the nucleic acid template molecule hybridized to the sequencing primer, wherein (1) the plurality of nucleic acid template molecules comprise a plurality of the immobilized concatemer template molecules and the plurality of soluble primers comprise a plurality of the soluble forward sequencing primers, or wherein (2) the plurality of nucleic acid template molecules comprise a plurality of the retained forward extension strands and the plurality of soluble sequencing primers comprise a plurality of the soluble reverse sequencing primers; b) contacting the plurality of first complexed polymerases with a plurality of detectably labeled multivalent molecules to form a plurality of multivalent-complexed polymerases, under a condition suitable for binding complementary nucleotide units of the multivalent molecules to at least two of the plurality of first complexed polymerases thereby forming a plurality of multivalent-complexed polymerases, and the condition inhibits incorporation of the complementary nucleotide units into the sequencing primers of the plurality of multivalent-complexed polymerases, wherein individual multivalent molecules in the plurality of multivalent molecules comprise a core attached to multiple nucleotide arms and each nucleotide arm is attached to a nucleotide unit; c) detecting the plurality of multivalent-complexed polymerases; and d) identifying the nucleo-base of the complementary nucleotide units that are bound to the plurality of first complexed polymerases in the plurality of multivalent-complexed polymerases, thereby determining the sequence of the nucleic acid template.

In some embodiments, the reverse sequencing of step comprises: hybridizing the plurality of soluble reverse sequencing primers to the plurality of the retained forward extension strands in the presence of a high efficiency hybridization buffer which comprises: (i) a first polar aprotic solvent which comprises acetonitrile at 25-50/a by volume of the hybridization buffer; (ii) a second polar aprotic solvent which comprises formamide at 5-10% by volume of the hybridization buffer; (iii) a pH buffering system which comprises 2-(N-morpholino)ethanesulfonic acid (MES) at a pH of 5-6.5; and (iv) a crowding agent which comprises polyethylene glycol (PEG) at 5-35% by volume of the hybridization buffer.

In some embodiments, the method further comprises: e) dissociating the plurality of multivalent-complexed polymerases and removing the plurality of first sequencing polymerases and their bound multivalent molecules, and retaining the plurality of nucleic acid duplexes; f) contacting the plurality of the retained nucleic acid duplexes of step (e) with a plurality of second sequencing polymerases, wherein the contacting is conducted under a condition suitable for binding the plurality of second sequencing polymerases to the plurality of the retained nucleic acid duplexes, thereby forming a plurality of second complexed polymerases each comprising a second sequencing polymerase bound to a retained nucleic acid duplex; g) contacting the plurality of second complexed polymerases with a plurality of nucleotides, wherein the contacting is conducted under a condition suitable for binding complementary nucleotides from the plurality of nucleotides to at least two of the second complexed polymerases of step (f) thereby forming a plurality of nucleotide-complexed polymerases and the condition is suitable for promoting incorporation of the bound complementary nucleotides into the sequencing primers of the nucleotide-complexed polymerases; h) detecting the complementary nucleotides which are incorporated into the sequencing primers of the nucleotide-complexed polymerases; and d) identifying the nucleo-bases of the complementary nucleotides which are incorporated into the sequencing primers of the nucleotide-complexed polymerases.

In some embodiments, the method further comprises: forming at least one avidity complex in step (b), the method comprising: a) binding a first sequencing primer, a first sequencing polymerase, and a first multivalent molecule to a first portion of a nucleic acid template molecule thereby forming a first binding complex, wherein a first nucleotide unit of the first multivalent molecule binds to the first sequencing polymerase; and b) binding a second sequencing primer, a second sequencing polymerase, and the first multivalent molecule to a second portion of the same nucleic acid template molecule thereby forming a second binding complex, wherein a second nucleotide unit of the second multivalent molecule binds to the second sequencing polymerase, wherein the first and second binding complexes which include the same multivalent molecule forms an avidity complex.

In some embodiments, (i) the first sequencing primer comprises a soluble forward sequencing primer and the nucleic acid template molecule comprises an immobilized concatemer template molecule, (ii) the second sequencing primer comprises a soluble forward sequencing primer and the nucleic acid template molecule comprises the same immobilized concatemer template molecule, and (iii) the first and second sequencing primers have the same sequence.

In some embodiments, wherein (i) the first sequencing primer comprises a soluble reverse sequencing primer and the nucleic acid template molecule comprises a retained forward extension strand, (ii) the second sequencing primer comprises a soluble reverse sequencing primer and the nucleic acid template molecule comprises the same retained forward extension strand, and (iii) the first and second sequencing primers have the same sequence.

In some embodiments, the method further comprises: forming at least one avidity complex in step (b), the method comprising: a) contacting a plurality of first sequencing polymerases and a plurality of second sequencing primers with different portions of a nucleic acid template molecule to form at least first and second complexed polymerases on the same nucleic acid template molecule; b) contacting a plurality of multivalent molecules to the at least first and second complexed polymerases on the same nucleic acid template molecule, under conditions suitable to bind a single multivalent molecule from the plurality to the first and second complexed polymerases, wherein at least a first nucleotide unit of the single multivalent molecule is bound to the first complexed polymerase which includes a first sequencing primer hybridized to a first portion of the nucleic acid template molecule thereby forming a first binding complex, and wherein at least a second nucleotide unit of the single multivalent molecule is bound to the second complexed polymerase which includes a second sequencing primer hybridized to a second portion of the same nucleic acid template molecule thereby forming a second binding complex, wherein the contacting is conducted under a condition suitable to inhibit polymerase-catalyzed incorporation of the bound first and second nucleotide units in the first and second binding complexes, and wherein the first and second binding complexes which are bound to the same multivalent molecule forms an avidity complex; c) detecting the first and second binding complexes on the same nucleic acid template molecule, and d) identifying the first nucleotide unit in the first binding complex thereby determining the sequence of the first portion of the nucleic acid template molecule, and identifying the second nucleotide unit in the second binding complex thereby determining the sequence of the second portion of the same nucleic acid template molecule.

In some embodiments, (i) the plurality of first sequencing primers comprise a plurality of first soluble forward sequencing primers and the nucleic acid template molecule comprises an immobilized concatemer template molecule, (ii) the plurality of second sequencing primers comprise a plurality of second soluble forward sequencing primers and the nucleic acid template molecule comprises the same immobilized concatemer template molecule, and (iii) the plurality of first and second sequencing primers have the same sequence.

In some embodiments, (i) the plurality of first sequencing primers comprises a plurality of first soluble reverse sequencing primer and the nucleic acid template molecule comprises a retained forward extension strand, (ii) the plurality of second sequencing primers comprise a plurality of second soluble reverse sequencing primers and the nucleic acid template molecule comprises the same retained forward extension strand, and (iii) the plurality of first and second sequencing primers have the same sequence.

In any of the foregoing or related embodiments, the forward sequencing step and the reverse sequencing step comprises: a) contacting a plurality of a first sequencing polymerase to (i) a plurality of nucleic acid template molecules and (ii) a plurality of soluble sequencing primers, wherein the contacting is conducted under a condition suitable to form a plurality of first complexed polymerases each comprising a first sequencing polymerase bound to a nucleic acid duplex wherein the nucleic acid duplex comprises the nucleic acid template molecule hybridized to the soluble sequencing primer, wherein (1) the plurality of nucleic acid template molecules comprise a plurality of the immobilized concatemer template molecules and the plurality of sequencing primers comprise a plurality of the soluble forward sequencing primers, or wherein (2) the plurality of nucleic acid template molecules comprise a plurality of immobilized partially displaced forward extension strands and the plurality of sequencing primers comprise a plurality of the soluble reverse sequencing primers, or wherein (3) the plurality of nucleic acid template molecules comprise a plurality of immobilized detached extended forward sequencing primer strands and the plurality of sequencing primers comprise a plurality of the soluble reverse sequencing primers; b) contacting the plurality of first complexed polymerases with a plurality of detectably labeled multivalent molecules to form a plurality of multivalent-complexed polymerases, under a condition suitable for binding complementary nucleotide units of the multivalent molecules to at least two of the plurality of first complexed polymerases thereby forming a plurality of multivalent-complexed polymerases, and the condition inhibits incorporation of the complementary nucleotide units into the sequencing primers of the plurality of multivalent-complexed polymerases, wherein individual multivalent molecules in the plurality of multivalent molecules comprise a core attached to multiple nucleotide arms and each nucleotide arm is attached to a nucleotide unit; c) detecting the plurality of multivalent-complexed polymerases; and d) identifying the nucleo-base of the complementary nucleotide units that are bound to the plurality of first complexed polymerases in the plurality of multivalent-complexed polymerases, thereby determining the sequence of the nucleic acid template.

In any of the foregoing or related embodiments, the reverse sequencing step comprises: hybridizing the plurality of soluble reverse sequencing primers to the plurality of immobilized partially displaced forward extension strands or the plurality of immobilized detached extended forward sequencing primer strands in the presence of a high efficiency hybridization buffer which comprises: (i) a first polar aprotic solvent which comprises acetonitrile at 25-50% by volume of the hybridization buffer; (ii) a second polar aprotic solvent which comprises formamide at 5-10% by volume of the hybridization buffer; (iii) a pH buffering system which comprises 2-(N-morpholino)ethanesulfonic acid (MES) at a pH of 5-6.5; and (iv) a crowding agent which comprises polyethylene glycol (PEG) at 5-35% by volume of the hybridization buffer.

In some embodiments, the method further comprises: e) dissociating the plurality of multivalent-complexed polymerases and removing the plurality of first sequencing polymerases and their bound multivalent molecules, and retaining the plurality of nucleic acid duplexes; f) contacting the plurality of the retained nucleic acid duplexes of step (e) with a plurality of second sequencing polymerases, wherein the contacting is conducted under a condition suitable for binding the plurality of second sequencing polymerases to the plurality of the retained nucleic acid duplexes, thereby forming a plurality of second complexed polymerases each comprising a second sequencing polymerase bound to a retained nucleic acid duplex; g) contacting the plurality of second complexed polymerases with a plurality of nucleotides, wherein the contacting is conducted under a condition suitable for binding complementary nucleotides from the plurality of nucleotides to at least two of the second complexed polymerases of step (f) thereby forming a plurality of nucleotide-complexed polymerases and the condition is suitable for promoting incorporation of the bound complementary nucleotides into the sequencing primers of the nucleotide-complexed polymerases; h) detecting the complementary nucleotides which are incorporated into the sequencing primers of the nucleotide-complexed polymerases; and i) identifying the nucleo-bases of the complementary nucleotides which are incorporated into the sequencing primers of the nucleotide-complexed polymerases.

In some embodiments, the method further comprises: forming at least one avidity complex in step (b), the method comprising: a) binding a first sequencing primer, a first sequencing polymerase, and a first multivalent molecule to a first portion of a nucleic acid template molecule thereby forming a first binding complex, wherein a first nucleotide unit of the first multivalent molecule binds to the first sequencing polymerase; and b) binding a second sequencing primer, a second sequencing polymerase, and the first multivalent molecule to a second portion of the same nucleic acid template molecule thereby forming a second binding complex, wherein a second nucleotide unit of the second multivalent molecule binds to the second sequencing polymerase, wherein the first and second binding complexes which include the same multivalent molecule forms an avidity complex.

In some embodiments, (i) the first sequencing primer comprises a soluble forward sequencing primer and the nucleic acid template molecule comprises an immobilized concatemer template molecule, (ii) the second sequencing primer comprises a soluble forward sequencing primer and the nucleic acid template molecule comprises the same immobilized concatemer template molecule, and (iii) the first and second sequencing primers have the same sequence. In some embodiments, (i) the first sequencing primer comprises a soluble reverse sequencing primer and the nucleic acid template molecule comprises an immobilized partially displaced forward extension strand, (ii) the second sequencing primer comprises a soluble reverse sequencing primer and the nucleic acid template molecule comprises the same immobilized partially displaced forward extension strand, and (iii) the first and second sequencing primers have the same sequence. In some embodiments, (i) the first sequencing primer comprises a soluble reverse sequencing primer and the nucleic acid template molecule comprises an immobilized detached extended forward sequencing primer strand, (ii) the second sequencing primer comprises a soluble reverse sequencing primer and the nucleic acid template molecule comprises the same immobilized detached extended forward sequencing primer strand, and (iii) the first and second sequencing primers have the same sequence.

In some embodiments, the method further comprises: forming at least one avidity complex in step (b), the method comprising: a) contacting a plurality of first sequencing polymerases and a plurality of second sequencing primers with different portions of a nucleic acid template molecule to form at least first and second complexed polymerases on the same nucleic acid template molecule; b) contacting a plurality of multivalent molecules to the at least first and second complexed polymerases on the same nucleic acid template molecule, under conditions suitable to bind a single multivalent molecule from the plurality to the first and second complexed polymerases, wherein at least a first nucleotide unit of the single multivalent molecule is bound to the first complexed polymerase which includes a first sequencing primer hybridized to a first portion of the nucleic acid template molecule thereby forming a first binding complex, and wherein at least a second nucleotide unit of the single multivalent molecule is bound to the second complexed polymerase which includes a second sequencing primer hybridized to a second portion of the same nucleic acid template molecule thereby forming a second binding complex, wherein the contacting is conducted under a condition suitable to inhibit polymerase-catalyzed incorporation of the bound first and second nucleotide units in the first and second binding complexes, and wherein the first and second binding complexes which are bound to the same multivalent molecule forms an avidity complex; c) detecting the first and second binding complexes on the same nucleic acid template molecule, and d) identifying the first nucleotide unit in the first binding complex thereby determining the sequence of the first portion of the nucleic acid template molecule, and identifying the second nucleotide unit in the second binding complex thereby determining the sequence of the second portion of the same nucleic acid template molecule.

In some embodiments, (i) the plurality of first sequencing primers comprise a plurality of first soluble forward sequencing primers and the nucleic acid template molecule comprises an immobilized concatemer template molecule, (ii) the plurality of second sequencing primers comprise a plurality of second soluble forward sequencing primers and the nucleic acid template molecule comprises the same immobilized concatemer template molecule, and (iii) the plurality of first and second sequencing primers have the same sequence. In some embodiments, (i) the plurality of first sequencing primers comprises a plurality of first soluble reverse sequencing primer and the nucleic acid template molecule comprises an immobilized partially displaced forward extension strand, (ii) the plurality of second sequencing primers comprise a plurality of second soluble reverse sequencing primers and the nucleic acid template molecule comprises the same immobilized partially displaced forward extension strand, and (iii) the plurality of first and second sequencing primers have the same sequence. In some embodiments, (i) the plurality of first sequencing primers comprises a plurality of first soluble reverse sequencing primer and the nucleic acid template molecule comprises an immobilized detached extended forward sequencing primer strands, (ii) the plurality of second sequencing primers comprise a plurality of second soluble reverse sequencing primers and the nucleic acid template molecule comprises the same immobilized detached extended forward sequencing primer strands, and (iii) the plurality of first and second sequencing primers have the same sequence.

In any of the foregoing or related embodiments, individual nucleotides in the plurality of nucleotides comprise an aromatic base, a five carbon sugar, and 1-10 phosphate groups, wherein the aromatic base of the nucleotide comprises adenine, guanine, cytosine, thymine or uracil. In some embodiments, the plurality of nucleotides comprises one type of nucleotide selected from a group consisting of dATP, dGTP, dCTP and dTTP. In some embodiments, the plurality of nucleotides comprises a mixture of any combination of two or more types of nucleotides selected from a group consisting of dATP, dGTP, dCTP and/or dTTP. In some embodiments, at least one of the nucleotides in the plurality of nucleotides comprises a fluorescently-labeled nucleotide. In some embodiments, at least one of the plurality of nucleotides lacks a fluorophore label.

In any of the foregoing or related embodiments, at least one of the nucleotides in the plurality of nucleotides comprises a chain terminating moiety attached to 3'-OH sugar position via cleavable moiety, and wherein the chain terminating moiety comprises an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group.

In some embodiments, the chain terminating moieties alkyl, alkenyl, alkynyl and allyl are cleavable/removable with tetrakis(triphenylphosphine)palladium(0) (Pd(PPh3)4) with piperidine, or with 2,3-Dichloro-5,6-dicyano-1,4-benzo-quinone (DDQ); (i) the chain terminating moieties aryl and benzyl are cleavable/removable with H2 Pd/C; (ii) the chain terminating moieties amine, amide, keto, isocyanate, phosphate, thio, disulfide are cleavable/removable with a thiol reagent which comprises beta-mercaptoethanol or dithiothritol (DTT); (iii) the chain terminating moieties amine, amide, keto, isocyanate, phosphate, thio, disulfide are cleavable/removable with a phosphine reagent which comprises Tris(2-carboxyethyl)phosphine (TCEP), bis-sulfo triphenyl phosphine (BS-TPP), or Tri(hydroxyproyl)phosphine (THPP); (iv) the chain terminating moieties amine, amide, keto, isocyanate, phosphate, thio, disulfide are cleavable/removable with 4-dimethylaminopyridine (4-DMAP); (v) the chain terminating moiety carbonate is cleavable/removable with potassium carbonate (K2CO3) in MeOH, with triethylamine in pyridine, or with Zn in acetic acid (AcOH); and (vi) the chain terminating moieties urea and silyl are cleavable with tetrabutylammonium fluoride, pyridine-HF, with ammonium fluoride, or with triethylamine trihydrofluoride.

In some embodiments, at least one of the nucleotides in the plurality of nucleotides comprises a chain terminating moiety attached to 3'-OH sugar position via cleavable moiety, and wherein the chain terminating moiety comprises a 3' O-azido or a 3' O-azidomethyl group. In some embodiments, (i) the chain terminating moieties 3' O-azido and 3' O-azidomethyl group are cleavable/removable with a phosphine compound which comprise a derivatized tri-alkyl phosphine moiety, derivatized tri-aryl phosphine moiety, Tris(2-carboxyethyl)phosphine (TCEP), bis-sulfo triphenyl phosphine (BS-TPP) or Tri(hydroxyproyl)phosphine (THPP); and (ii) the chain terminating moieties 3' O-azido and 3' O-azidomethyl group are cleavable/removable with 4-dimethylaminopyridine (4-DMAP).

In any of the foregoing or related embodiments, individual multivalent molecules in the plurality of multivalent molecules comprises (a) a core; and (b) a plurality of nucleotide arms which comprise (i) a core attachment moiety, (ii) a spacer comprising a PEG moiety, (iii) a linker, and (iv) a nucleotide unit, wherein the core is attached to the plurality of nucleotide arms via their core attachment moiety, wherein the spacer is attached to the linker, and wherein the linker is attached to the nucleotide unit.

In some embodiments, the core comprises an avidin-type moiety and the core attachment moiety comprises biotin. In some embodiments, the linker comprises an aliphatic chain having 2-6 subunits or an oligo ethylene glycol chain having 2-6 subunits. In some embodiments, the linker further comprises an aromatic moiety. In some embodiments, the nucleotide unit comprises an aromatic base, a five carbon sugar and 1-10 phosphate groups. In some embodiments, the linker is attached to the nucleotide unit through the base.

In some embodiments, the plurality of nucleotide arms attached to the core have the same type of a nucleotide unit, and wherein the types of nucleotide unit is selected from a group consisting of dATP, dGTP, dCTP, dTTP and dUTP. In some embodiments, the plurality of multivalent molecules comprise one type of a multivalent molecule wherein each multivalent molecule in the plurality has the same type of nucleotide unit selected from a group consisting of dATP, dGTP, dCTP, dTTP and dUTP. In some embodiments, the plurality of multivalent molecules comprise a mixture of any combination of two or more types of multivalent molecules each type having nucleotide units selected from a group consisting of dATP, dGTP, dCTP, dTTP and/or dUTP.

In some embodiments, the plurality of multivalent molecules are fluorescently-labeled multivalent molecules. In some embodiments, (i) the core of individual fluorescently-labeled multivalent molecules is attached to a fluorophore which corresponds to the nucleotide units that are attached to the nucleotide arms; (ii) at least one of the nucleotide arms comprises a linker that is attached to a fluorophore which corresponds to the nucleotide units that are attached to the nucleotide arms; and/or (iii) at least one of the nucleotide arms comprises a nucleotide unit that is attached to a fluorophore which corresponds to the nucleotide units that are attached to the nucleotide arms.

In some embodiments, the plurality of multivalent molecules lack a fluorophore.

In some embodiments, at least one of the multivalent molecules in the plurality of multivalent molecules comprises nucleotide units having a chain terminating moiety attached to the 3'-OH sugar position via a cleavable moiety, and wherein the chain terminating moiety comprises an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group.

In some embodiments, (i) the chain terminating moieties alkyl, alkenyl, alkynyl and allyl are cleavable/removable with tetrakis(triphenylphosphine)palladium(0) (Pd(PPh3)4) with piperidine, or with 2,3-Dichloro-5,6-dicyano-1,4-benzo-quinone (DDQ); (ii) the chain terminating moieties aryl and benzyl are cleavable/removable with H2 Pd/C; (iii) the chain terminating moieties amine, amide, keto, isocyanate, phosphate, thio, disulfide are cleavable/removable with a thiol reagent which comprises beta-mercaptoethanol or dithiothritol (DTT); (iv) the chain terminating moieties amine, amide, keto, isocyanate, phosphate, thio, disulfide are cleavable/removable with a phosphine reagent which comprises Tris(2-carboxyethyl)phosphine (TCEP), bis-sulfo triphenyl phosphine (BS-TPP), or Tri(hydroxyproyl)phosphine (THPP); (v) the chain terminating moieties amine, amide, keto, isocyanate, phosphate, thio, disulfide are cleavable/removable with 4-dimethylaminopyridine (4-DMAP); (vi) the chain terminating moiety carbonate is cleavable/removable with potassium carbonate (K2CO3) in MeOH, with triethylamine in pyridine, or with Zn in acetic acid (AcOH); and (vii) the chain terminating moieties urea and silyl are cleavable with tetrabutylammonium fluoride, pyridine-HF, with ammonium fluoride, or with triethylamine trihydrofluoride.

In some embodiments, at least one of the multivalent molecules in the plurality of multivalent molecules comprises nucleotide units having a chain terminating moiety attached to the 3'-OH sugar position via a cleavable moiety, and wherein the chain terminating moiety comprises a 3' O-azido or 3' O-azidomethyl group.

In some embodiments, (i) the chain terminating moieties 3' O-azido and 3' O-azidomethyl group are cleavable/removable with a phosphine compound which comprise a derivatized tri-alkyl phosphine moiety, derivatized tri-aryl phosphine moiety, Tris(2-carboxyethyl)phosphine (TCEP), bis-sulfo triphenyl phosphine (BS-TPP) or Tri(hydroxyproyl) phosphine (THPP); and (ii) the chain terminating moieties 3' O-azido and 3' O-azidomethyl are cleavable/removable with 4-dimethylaminopyridine (4-DMAP).

In some embodiments, the plurality of first sequencing polymerases of step (a) comprise a recombinant wild type DNA polymerase. In some embodiments, the plurality of first sequencing polymerases of step (a) comprise mutant DNA polymerase.

In some embodiments, the plurality of sequencing polymerases in step (a) comprises a recombinant wild type DNA polymerase, and the plurality of nucleotides in step (b) comprises fluorescently-labeled nucleotides having a removable chain terminating moiety at the 3' sugar position. In some embodiments, the plurality of sequencing polymerases in step (a) comprises a mutant DNA polymerase, and the plurality of nucleotides in step (b) comprises fluorescently-labeled nucleotides having a removable chain terminating moiety at the 3' sugar position.

In some embodiments, the plurality of second sequencing polymerases of step (f) comprise recombinant wild type DNA polymerase, and the plurality of nucleotides in step (b) comprises fluorescently-labeled nucleotides having a removable chain terminating moiety at the 3' sugar position. In some embodiments, the plurality of second sequencing polymerases of step (f) comprise mutant DNA polymerase, and the plurality of nucleotides in step (b) comprises fluorescently-labeled nucleotides having a removable chain terminating moiety at the 3' sugar position.

In any of the foregoing or related embodiments, the replacing the plurality of extended forward sequencing primer strands with a plurality of forward extension strands that are hybridized to the retained immobilized single stranded nucleic acid concatemer template molecules by conducting a primer extension reaction comprises: (i) contacting at least one extended forward sequencing primer strand with a plurality of strand displacing polymerases and a plurality of nucleotides and in the absence of soluble amplification primers, under a condition suitable to conduct a strand displacing primer extension reaction using the at least one extended forward sequencing primers strand to initiate the primer extension reaction thereby generating a forward extension strand that is covalently joined to the extended forward sequencing primers strand, wherein the forward extension strand is hybridized to the immobilized concatemer template molecule.

In any of the foregoing or related embodiments, the replacing the plurality of extended forward sequencing primer strands with a plurality of forward extension strands that are hybridized to the retained immobilized single stranded nucleic acid concatemer template molecules by conducting a primer extension reaction comprises removing the plurality of extended forward sequencing primer strands by: (i) contacting the plurality of extended forward sequencing primer strands with a 5' to 3' double-stranded DNA exonuclease; (ii) contacting the plurality of extended forward sequencing primer strands with a denaturation reagent comprising any combination of formamide, acetonitrile, guanidinium chloride and/or a pH buffering agent; or (iii) contacting the plurality of extended forward sequencing primer strands with 100% formamide.

In any of the foregoing or related embodiments, the replacing the plurality of extended forward sequencing primer strands with a plurality of forward extension strands that are hybridized to the retained immobilized single stranded nucleic acid concatemer template molecules by conducting a primer extension reaction comprises: (i) removing the plurality of extended forward sequencing primer strands while retaining the immobilized concatemer template molecules; and (ii) contacting the plurality of retained immobilized concatemer molecules with a second plurality of soluble forward sequencing primers, a plurality of nucleotides and a plurality of primer extension polymerases, under a condition suitable to hybridize the plurality of soluble forward sequencing primers to the plurality of retained immobilized concatemer template molecules and suitable for conducting polymerase-catalyzed primer extension reactions thereby generating a plurality of forward extension strands, wherein the plurality of nucleotides comprise dATP, dGTP, dCTP and dTTP but lacks dUTP, wherein in the plurality of primer extension polymerases are tolerant of uridine-containing template strands, and wherein the soluble sequencing primers hybridize with the forward sequencing primer binding sequence in the retained immobilized concatemer molecules.

In some embodiments, the contacting comprises: contacting the plurality of retained immobilized concatemer molecules with the plurality of soluble forward sequencing primers in the presence of a high efficiency hybridization buffer which comprises: (i) a first polar aprotic solvent which comprises acetonitrile at 25-50% by volume of the hybridization buffer; (ii) a second polar aprotic solvent which comprises formamide at 5-10% by volume of the hybridization buffer; (iii) a pH buffering system which comprises 2-(N-morpholino)ethanesulfonic acid (MES) at a pH of 5-6.5; and (iv) a crowding agent which comprises polyethylene glycol (PEG) at 5-35% by volume of the hybridization buffer.

In any of the foregoing or related embodiments, the replacing the plurality of extended forward sequencing primer strands with a plurality of forward extension strands that are hybridized to the retained immobilized single stranded nucleic acid concatemer template molecules by conducting a primer extension reaction comprises: (i) removing the plurality of extended forward sequencing primer strand while retaining the immobilized concatemer template molecules; and (ii) contacting the plurality of retained immobilized concatemer molecules with a plurality of soluble amplification primers, a plurality of nucleotides and a plurality of primer extension polymerases, under a condition suitable to hybridize the plurality of soluble amplification primers to the plurality of retained immobilized concatemer template molecules and suitable for conducting polymerase-catalyzed primer extension reactions thereby generating a plurality of forward extension strands, wherein the soluble amplification primers hybridize with the soluble amplification primer binding sequence in the retained immobilized concatemer molecules, wherein the plurality of nucleotides comprise dATP, dGTP, dCTP and dTTP but lacks dUTP, wherein in the plurality of primer extension polymerases are tolerant of uridine-containing template strands, and wherein the soluble sequencing primers hybridize with the forward sequencing primer binding sequence in the retained immobilized concatemer molecules.

In some embodiments, the contacting comprises: contacting the plurality of retained immobilized concatemer molecules with the plurality of soluble amplification primers in the presence of a high efficiency hybridization buffer which comprises: (i) a first polar aprotic solvent which comprises acetonitrile at 25-50% by volume of the hybridization buffer; (ii) a second polar aprotic solvent which comprises formamide at 5-10% by volume of the hybridization buffer; (iii) a pH buffering system which comprises 2-(N-morpholino)ethanesulfonic acid (MES) at a pH of 5-6.5; and (iv) a crowding agent which comprises polyethylene glycol (PEG) at 5-35% by volume of the hybridization buffer.

In some embodiments, the method further comprises: contacting the plurality of retained immobilized concatemer molecules with a plurality of soluble compaction oligonucleotides.

In any of the foregoing or related embodiments, the replacing the plurality of extended forward sequencing primer strands comprises: (i) contacting at least one extended forward sequencing primer strand with a plurality of strand displacing polymerases and a plurality of nucleotides and in the absence of soluble amplification primers, under a condition suitable to conduct a strand displacing primer extension reaction using the at least one extended forward sequencing primer strand to initiate the primer extension reaction thereby generating a plurality of forward extension strands, a plurality of partially displaced extended forward sequencing strands and a plurality of detached extended forward sequencing primer strands.

In any of the foregoing or related embodiments, replacing the plurality of extended forward sequencing primer strands comprises: comprises removing the plurality of extended forward sequencing primer strands by: (i) contacting the plurality of extended forward sequencing primer strands with a 5' to 3' double-stranded DNA exonuclease; (ii) contacting the plurality of extended forward sequencing primer strands with a denaturation reagent comprising any combination of formamide, acetonitrile, guanidinium chloride and/or a pH buffering agent; or (iii) contacting the plurality of extended forward sequencing primer strands with 100% formamide.

In any of the foregoing or related embodiments, the replacing the plurality of extended forward sequencing primer strands comprises: (i) removing the plurality of extended forward sequencing primer strands while retaining the immobilized concatemer template molecules; and (ii) contacting the plurality of retained immobilized concatemer molecules with a second plurality of soluble forward sequencing primers, a plurality of nucleotides and a plurality of strand displacing polymerases, under a condition suitable to hybridize the plurality of soluble forward sequencing primers to the plurality of retained immobilized concatemer template molecules and suitable for conducting polymerase-catalyzed strand displacing reactions thereby generating a plurality of forward extension strands and a plurality of partially displaced extended forward sequencing strands that are hybridized to the immobilized concatemer template molecules to form a plurality of immobilized amplicons, and the primer extension reaction generates a plurality of detached extended forward sequencing primer strands (e.g., that are not hybridized to the immobilized concatemer template molecules), wherein the plurality of nucleotides comprise dATP, dGTP, dCTP and dTTP but lacks dUTP, and wherein the soluble forward sequencing primers hybridize with the forward sequencing primer binding sequence in the retained immobilized concatemer molecules.

In some embodiments, the contacting comprises: contacting the plurality of retained immobilized concatemer molecules with the plurality of soluble forward sequencing primers in the presence of a high efficiency hybridization buffer which comprises: (i) a first polar aprotic solvent which comprises acetonitrile at 25-50% by volume of the hybridization buffer; (ii) a second polar aprotic solvent which comprises formamide at 5-10% by volume of the hybridization buffer; (iii) a pH buffering system which comprises 2-(N-morpholino)ethanesulfonic acid (MES) at a pH of 5-6.5; and (iv) a crowding agent which comprises polyethylene glycol (PEG) at 5-35% by volume of the hybridization buffer.

In any of the foregoing or related embodiments, the replacing the plurality of extended forward sequencing primer strands comprises: (i) removing the plurality of extended forward sequencing primer strand while retaining the immobilized concatemer template molecules; and (ii) contacting the plurality of retained immobilized concatemer molecules with a plurality of soluble amplification primers, a plurality of nucleotides and a plurality of strand displacing polymerases, under a condition suitable to hybridize the plurality of soluble amplification primers to the plurality of retained immobilized concatemer template molecules and suitable for conducting polymerase-catalyzed strand displacing reactions thereby generating a plurality of forward extension strands and a plurality of partially displaced extended forward sequencing strands that are hybridized to the immobilized concatemer template molecules to form a plurality of immobilized amplicons, and the primer extension reaction generates a plurality of detached extended forward sequencing primer strands (e.g., that are not hybridized to the immobilized concatemer template molecules), wherein the plurality of nucleotides comprise dATP, dGTP, dCTP and dTTP but lacks dUTP, wherein the soluble amplification primers hybridize with the soluble amplification primer binding sequence in the retained immobilized concatemer molecules.

In some embodiments, the contacting comprises: contacting the plurality of retained immobilized concatemer molecules with the plurality of soluble amplification primers in the presence of a high efficiency hybridization buffer which comprises: (i) a first polar aprotic solvent which comprises acetonitrile at 25-50% by volume of the hybridization buffer; (ii) a second polar aprotic solvent which comprises formamide at 5-10% by volume of the hybridization buffer; (iii) a pH buffering system which comprises 2-(N-morpholino)ethanesulfonic acid (MES) at a pH of 5-6.5; and (iv) a crowding agent which comprises polyethylene glycol (PEG) at 5-35% by volume of the hybridization buffer.

In any of the foregoing or related embodiments, the at least one of the retained immobilized concatemer template molecules includes one or more nucleotides having a scissile moiety, and wherein the scissile moiety comprises uridine or 8-oxo-7,8-dihydroguanine, or deoxyinosine. In any of the foregoing or related embodiments, the retained immobilized concatemer template molecule comprises one or more uridines, and wherein the generating the abasic sites at the uridines comprises contacting the retained immobilized concatemer template molecule with uracil DNA glycosylase (UDG). In any of the foregoing or related embodiments, the retained immobilized concatemer template molecule comprises one or more 8oxoG, and wherein the generating the abasic sites at the 8oxoG comprises contacting the retained immobilized concatemer template molecule with an Fpg enzyme (formamidopyrimidine DNA glycosylase). In any of the foregoing or related embodiments, the retained immobilized concatemer template molecule comprises one or more deoxyinosine, and wherein the generating the abasic sites at the deoxyinosine comprises contacting the retained immobilized concatemer template molecule with an AlkA glycosylase enzyme.

In any of the foregoing or related embodiments, the method further comprises generating a gap at the abasic sites to generate at least one gap-containing concatemer template molecule, which comprises: contacting the retained immobilized template molecules containing one or more abasic sites with an endonuclease IV, AP lyase (e.g., DNA-apurinic lyase or DNA-apyrimidinic lyase), FPG glycosylase/AP lyase and/or endo VIII glycosylase/AP lyase.

In any of the foregoing or related embodiments, the immobilized concatemer template molecules comprise 0.1-30% uridine, and wherein the plurality of wild type sequencing polymerases yield an error rate of incorporating dUTP of at least 0.1× compared to an error rate of incorporating dTTP. In any of the foregoing or related embodiments, the immobilized concatemer template molecules comprise 0.1-30% uridine, and wherein the plurality of mutant sequencing polymerases yield an error rate of incorporating dUTP of at least 0.1× compared to an error rate of incorporating dTTP. In any of the foregoing or related embodiments, the immobilized concatemer template molecules comprise 0.1-30% uridine, and wherein the plurality of wild type sequencing polymerases yield an error rate of incorporating dUTP of at least 0.1× compared to an error rate of incorporating dTTP. In any of the foregoing or related embodiments, the immobilized concatemer template molecules comprise 0.1-30% uridine, and wherein the plurality of mutant sequencing polymerases yield an error rate of incorporating dUTP of at least 0.1× compared to an error rate of incorporating dTTP.

In any of the foregoing or related embodiments, the ratio of a first base fluorescent signal of R2 (e.g., reverse sequencing) to a first base fluorescent signal of R1 (e.g., forward sequencing) is at least 0.7 for sequencing using 1, 2, 3 or 4 dyes colors.

In any of the foregoing or related embodiments, the rolling circle amplification step comprises a plurality of compaction oligonucleotides and/or hexamine to generate immobilized concatemer template molecules having a more compact size and/or shape compared to a rolling circle amplification reaction in the absence of compaction oligonucleotides and/or hexamine.

In any of the foregoing or related embodiments, the primer extension reaction of step comprises a plurality of compaction oligonucleotides and/or hexamine to generate a plurality of forward extension strands having a more compact size and/or shape compared to a primer extension reaction in the absence of compaction oligonucleotides and/or hexamine.

In any of the foregoing or related embodiments, the rolling circle amplification step comprises a plurality of compaction oligonucleotides and/or hexamine to generate concatemer molecules having a more compact size and/or shape compared to a rolling circle amplification reaction in the absence of compaction oligonucleotides and/or hexamine.

In any of the foregoing or related embodiments, the primer extension reaction step comprises a plurality of compaction oligonucleotides and/or hexamine to generate a plurality of forward extension strands having a more compact size and/or shape compared to a primer extension reaction in the absence of compaction oligonucleotides and/or hexamine.

In any of the foregoing or related embodiments, the rolling circle amplification step comprises a plurality of compaction oligonucleotides and/or hexamine to generate immobilized concatemer template molecules having a more compact size and/or shape compared to a rolling circle amplification reaction in the absence of compaction oligonucleotides and/or hexamine.

In any of the foregoing or related embodiments, the primer extension reaction step comprises a plurality of compaction oligonucleotides and/or hexamine to generate a plurality of forward extension strands having a more compact size and/or shape compared to a primer extension reaction in the absence of compaction oligonucleotides and/or hexamine.

In any of the foregoing or related embodiments, the primer extension reaction step comprises a plurality of compaction oligonucleotides and/or hexamine to generate a plurality of primer extension products having a more compact size and/or shape compared to a primer extension reaction in the absence of compaction oligonucleotides and/or hexamine, wherein the plurality of primer extension products include a plurality of forward extension strands, a plurality of partially displaced extended forward sequencing strands and a plurality of detached extended forward sequencing primer strands.

In any of the foregoing or related embodiments, the rolling circle amplification step comprises a plurality of compaction oligonucleotides and/or hexamine to generate immobilized concatemer template molecules having a more compact size and/or shape compared to a rolling circle amplification reaction in the absence of compaction oligonucleotides and/or hexamine.

In any of the foregoing or related embodiments, the primer extension reaction step comprises a plurality of compaction oligonucleotides and/or hexamine to generate a plurality of primer extension products having a more compact size and/or shape compared to a primer extension reaction in the absence of compaction oligonucleotides and/or hexamine, wherein the plurality of primer extension products include a plurality of forward extension strands, a plurality of partially displaced extended forward sequencing strands and a plurality of detached extended forward sequencing primer strands.

In any of the foregoing or related embodiments, the rolling circle amplification step comprises a plurality of compaction oligonucleotides and/or hexamine to generate a plurality of concatemer molecules having a more compact size and/or shape compared to a rolling circle amplification reaction in the absence of compaction oligonucleotides and/or hexamine.

In any of the foregoing or related embodiments, the primer extension reaction step comprises a plurality of compaction oligonucleotides and/or hexamine to generate a plurality of primer extension products having a more compact size and/or shape compared to a primer extension reaction in the absence of compaction oligonucleotides and/or hexamine, wherein the plurality of primer extension products include a plurality of forward extension strands, a plurality of partially displaced extended forward sequencing strands and a plurality of detached extended forward sequencing primer strands.

In any of the foregoing or related embodiments, the plurality of immobilized concatemer template molecules or the plurality of immobilized concatemer molecules have FWHM (full width half maximum) of no more than about 5 μm. In any of the foregoing or related embodiments, the plurality of forward extension strand have FWHM (full width half maximum) of no more than about 5 μm. In any of the foregoing or related embodiments, the plurality of primer extension products have FWHM (full width half maximum) of no more than about 5 μm.

DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 2 is a schematic showing an exemplary forward sequencing reaction conducted on the immobilized concatemer template molecule shown in FIG. 1. The forward sequencing reaction can be conducted with a plurality of soluble forward sequencing primers and generates a plurality of extended forward sequencing primer strands. The immobilized concatemer template molecule can have two or more extended forward sequencing primer strands hybridized thereon.

FIG. 3 is a schematic showing an exemplary method for replacing the extended forward sequencing primer strands by conducting a primer extension reaction with a strand displacing polymerase in the absence of a soluble primer thereby generating a forward extension strand.

FIG. 4 is a schematic showing an exemplary method for replacing the extended forward sequencing primer strands by conducting a primer extension reaction with a soluble forward sequencing primer thereby generating a forward extension strand.

FIG. 5 is a schematic showing an exemplary method for replacing the extended forward sequencing primer strands by conducting a primer extension reaction with a soluble amplification primer thereby generating a forward extension strand.

FIG. 6 is a schematic showing an exemplary method for generating abasic sites in the immobilized single stranded concatemer template molecules at the nucleotides having the scissile moiety and generating gaps at the abasic sites to generate a plurality of gap-containing concatemer template molecules while retaining the plurality of forward extension strands and retaining the plurality of immobilized first surface primers. The forward extension strand can be generated by the method depicted in FIG. 3 or 4.

FIG. 7 is a schematic showing an exemplary retained forward extension strand after removal of the gap-containing concatemer template molecule as shown in FIG. 6.

FIG. 8 is a schematic showing an exemplary is a schematic showing an exemplary method for generating abasic sites in the immobilized single stranded concatemer template molecules at the nucleotides having the scissile moiety and generating gaps at the abasic sites to generate a plurality of gap-containing concatemer template molecules while retaining the plurality of forward extension strands and retaining the plurality of immobilized first surface primers. The forward extension strand can be generated by the method depicted in FIG. 5.

FIG. 9 is a schematic showing an exemplary retained forward extension strand after removal of the gap-containing concatemer template molecule as shown in FIG. 8.

FIG. 10 is a schematic showing an exemplary reverse sequencing reaction conducted on the retained forward extension strand shown in FIG. 7. The reverse sequencing reaction can be conducted with a plurality of soluble reverse sequencing primers. The retained forward extension strand can have two or more extended reverse sequencing primer strands hybridized thereon. The extended reverse sequencing primer strands are not hybridized to the first surface primer, or covalently joined to the first surface primer. Therefore, the extended reverse sequencing primer strands are not immobilized to the support. For the sake of simplicity, FIGS. 1-10 show an exemplary immobilized concatemer molecule with one copy of the sequence of interest and various universal primer binding sites. The skilled artisan will appreciate that the immobilized concatemer molecule can include two or more tandem copies containing the sequence of interest and various universal primer binding sites.

FIG. 11 is a schematic showing an exemplary reverse sequencing reaction conducted on the retained forward extension strand shown in FIG. 9. The retained forward extension strand can have two or more extended reverse sequencing primer strands hybridized thereon. The extended reverse sequencing primer strands are not hybridized to the first surface primer, or covalently joined to the first surface primer. Therefore, the extended reverse sequencing primer strands are not immobilized to the support. For the sake of simplicity, FIGS. 1-11 show an exemplary immobilized concatemer molecule with one copy of the sequence of interest and various universal primer binding sites. The skilled artisan will appreciate that the immobilized concatemer molecule can include two or more tandem copies containing the sequence of interest and various universal primer binding sites.

FIG. 12 is a schematic showing an exemplary support having a first and second surface primers immobilized thereon. A portion of the immobilized concatemer template molecule shown in FIG. 1 is hybridized to the immobilized second surface primer. The immobilized concatemer template molecule has two or more copies of a universal binding sequence for an immobilized second surface primer. The portion of the immobilized concatemer template molecule that includes the universal binding sequence for an immobilized second surface primer can hybridize to the immobilized second surface primer.

FIG. 14 is a schematic showing an exemplary forward sequencing reaction conducted on the immobilized concatemer template molecule shown in FIG. 13. The forward sequencing reaction can be conducted with a plurality of soluble forward sequencing primers. The immobilized concatemer template molecule can have two or more extended forward sequencing primer strands hybridized thereon.

FIG. 15 is a schematic showing an exemplary method for replacing the extended forward sequencing primer strands by conducting a primer extension reaction with a strand displacing polymerase in the absence of a soluble primer.

FIG. 16 is a schematic showing an exemplary method for replacing the extended forward sequencing primer strands by conducting a primer extension reaction with a soluble forward sequencing primer.

FIG. 17 is a schematic showing an exemplary method for replacing the extended forward sequencing primer strands by conducting a primer extension reaction with a soluble amplification primer.

FIG. 18 is a schematic showing an exemplary method for generating abasic sites in the immobilized single stranded concatemer template molecules at the nucleotides having the scissile moiety and generating gaps at the abasic sites to generate a plurality of gap-containing concatemer template molecules while retaining the plurality of forward extension strands and retaining the plurality of immobilized first surface primers. The forward extension strand can be generated by the method depicted in FIG. 15 or 16.

FIG. 19 is a schematic showing an exemplary retained forward extension strand after removal of the gap-containing concatemer template molecule as shown in FIG. 18.

FIG. 20 is a schematic showing an exemplary method for generating abasic sites in the immobilized single stranded concatemer template molecules at the nucleotides having the scissile moiety and generating gaps at the abasic sites to generate a plurality of gap-containing concatemer template molecules while retaining the plurality of forward extension strands and retaining the plurality of immobilized first surface primers. The forward extension strand can be generated by the method depicted in FIG. 17.

FIG. 21 is a schematic showing an exemplary retained forward extension strand after removal of the gap-containing concatemer template molecule as shown in FIG. 20.

FIG. 22 is a schematic showing an exemplary reverse sequencing reaction conducted on the retained forward extension strand shown in FIG. 19. The reverse sequencing reaction can be conducted with a plurality of soluble reverse sequencing primers. The retained forward extension strand depicted in FIG. 22 is a concatemer molecule that can include two or more tandem copies of the sequence of interest and various primer binding sites. Such a concatemer molecule can have two or more extended reverse sequencing primer strands hybridized thereon. The extended reverse sequencing primer strands are not hybridized to the first surface primer, or covalently joined to the first surface primer. Therefore, the extended reverse sequencing primer strands are not immobilized to the support. For the sake of simplicity, FIGS. 13-23 show an exemplary immobilized concatemer molecule with one copy of the sequence of interest and various universal primer binding sites. The skilled artisan will appreciate that the immobilized concatemer molecule can include two or more tandem copies containing the sequence of interest and various universal primer binding sites.

FIG. 23 is a schematic showing an exemplary reverse sequencing reaction conducted on the retained forward extension strand shown in FIG. 21. The retained forward extension strand can have two or more extended reverse sequencing primer strands hybridized thereon. The retained forward extension strand depicted in FIG. 23 is a concatemer molecule that includes two or more tandem copies of the sequence of interest and various primer binding sites. Such a concatemer molecule can have two or more extended reverse sequencing primer strands hybridized thereon. The extended reverse sequencing primer strands are not hybridized to the first surface primer, or covalently joined to the first surface primer. Therefore, the extended reverse sequencing primer strands are not immobilized to the support. For the sake of simplicity, FIGS. 13-23 show an exemplary immobilized concatemer molecule with two tandem copies containing the sequence of interest and various universal primer binding sites. The skilled artisan will appreciate that the immobilized concatemer molecule can include three or more tandem copies containing the sequence of interest and various universal primer binding sites.

FIG. 24 is a schematic showing an exemplary support having a first and second surface primers immobilized thereon. A portion of the immobilized concatemer template molecule shown in FIG. 13 is hybridized to the immobilized second surface primer. The immobilized concatemer template molecule has two or more copies of a universal binding sequence for an immobilized second surface primer. The portion of the immobilized concatemer template molecule that includes the universal binding sequence for an immobilized second surface primer can hybridize to the immobilized second surface primer.

FIG. 25 is a schematic showing an exemplary support having a first surface primer immobilized thereon, which in some embodiments, can be used to conduct an on-support pairwise sequencing workflow.

FIGS. 26-37 show the workflow of pairwise sequencing the immobilized concatemer template molecule depicted in FIG. 26.

FIG. 27 is a schematic showing an exemplary forward sequencing reaction conducted on the immobilized concatemer template molecule shown in FIG. 26. The forward sequencing reaction can be conducted with a plurality of soluble forward sequencing primers and generates a plurality of extended forward sequencing primer strands. The immobilized concatemer template molecule can have two or more extended forward sequencing primer strands hybridized thereon.

FIG. 28 is a schematic showing an exemplary method for replacing the extended forward sequencing primer strands by conducting a primer extension reaction with a strand displacing polymerase in the absence of a soluble primer thereby generating a forward extension strand.

FIG. 29 is a schematic showing an exemplary method for replacing the extended forward sequencing primer strands by conducting a primer extension reaction with a soluble forward sequencing primer thereby generating a forward extension strand.

FIG. 30 is a schematic showing an exemplary method for replacing the extended forward sequencing primer strands by conducting a primer extension reaction with a soluble amplification primer thereby generating a forward extension strand.

FIG. 31 is a schematic showing an exemplary method for generating abasic sites in the immobilized single stranded concatemer template molecules at the nucleotides having the scissile moiety and generating gaps at the abasic sites to generate a plurality of gap-containing concatemer template molecules while retaining the plurality of forward extension strands and retaining the plurality of immobilized first surface primers. The forward extension strand can be generated by the method depicted in FIG. 28 or 29.

FIG. 32 is a schematic showing an exemplary retained forward extension strand after removal of the gap-containing concatemer template molecule as shown in FIG. 31.

FIG. 33 is a schematic showing an exemplary method for generating abasic sites in the immobilized single stranded concatemer template molecules at the nucleotides having the scissile moiety and generating gaps at the abasic sites to generate a plurality of gap-containing concatemer template molecules while retaining the plurality of forward extension strands and retaining the plurality of immobilized first surface primers. The forward extension strand can be generated by the method depicted in FIG. 30.

FIG. 34 is a schematic showing an exemplary retained forward extension strand after removal of the gap-containing concatemer template molecule as shown in FIG. 33.

FIG. 35 is a schematic showing an exemplary reverse sequencing reaction conducted on the retained forward extension strand shown in FIG. 32. The reverse sequencing reaction can be conducted with a plurality of soluble reverse sequencing primers. The retained forward extension strand can have two or more extended reverse sequencing primer strands hybridized thereon. The extended reverse sequencing primer strands are not hybridized to the first surface primer, or covalently joined to the first surface primer. Therefore, the extended reverse sequencing primer strands are not immobilized to the support. For the sake of simplicity, FIGS. 26-36 show an exemplary immobilized concatemer molecule with one copy of the sequence of interest and various universal primer binding sites. The skilled artisan will appreciate that the immobilized concatemer molecule can include two or more tandem copies containing the sequence of interest and various universal primer binding sites.

FIG. 36 is a schematic showing an exemplary reverse sequencing reaction conducted on the retained forward extension strand shown in FIG. 34. The retained forward extension strand can have two or more extended reverse sequencing primer strands hybridized thereon. The extended reverse sequencing primer strands are not hybridized to the first surface primer, or covalently joined to the first surface primer. Therefore, the extended reverse sequencing primer strands are not immobilized to the support. For the sake of simplicity, FIGS. 26-36 show an exemplary immobilized concatemer molecule with one copy of the sequence of interest and various universal primer binding sites. The skilled artisan will appreciate that the immobilized concatemer molecule can include two or more tandem copies containing the sequence of interest and various universal primer binding sites.

FIG. 37 is a schematic showing an exemplary support having a first and second surface primers immobilized thereon. A portion of the immobilized concatemer template molecule shown in FIG. 26 is hybridized to the immobilized second surface primer. The immobilized concatemer template molecule has two or more copies of a universal binding sequence for an immobilized second surface primer. The portion of the immobilized concatemer template molecule that includes the universal binding sequence for an immobilized second surface primer can hybridize to the immobilized second surface primer.

FIGS. 38-52 show the workflow of pairwise sequencing the concatemer molecule depicted in FIG. 38.

FIG. 39 is a schematic showing an exemplary method comprising distributing the rolling circle amplification reaction depicted in FIG. 38 onto a support having a first surface primer immobilized thereon. The concatemer molecule can hybridize to the immobilized first surface primer.

FIG. 40 is a schematic showing an exemplary method which depicts the rolling circle amplification reaction continuing on the support thereby generating an immobilized concatemer template molecule which includes at least one nucleotide with a scissile moiety which can be cleaved to generate an abasic site in the immobilized concatemer template molecule.

FIG. 41 is a schematic showing an exemplary immobilized concatemer template molecule generated by the method depicted in FIG. 40.

FIG. 42 is a schematic showing an exemplary forward sequencing reaction conducted on the immobilized concatemer template molecule shown in FIG. 41. The forward sequencing reaction can be conducted with a plurality of soluble forward sequencing primers.

The immobilized concatemer template molecule can have two or more extended forward sequencing primer strands hybridized thereon.

Figure 43:
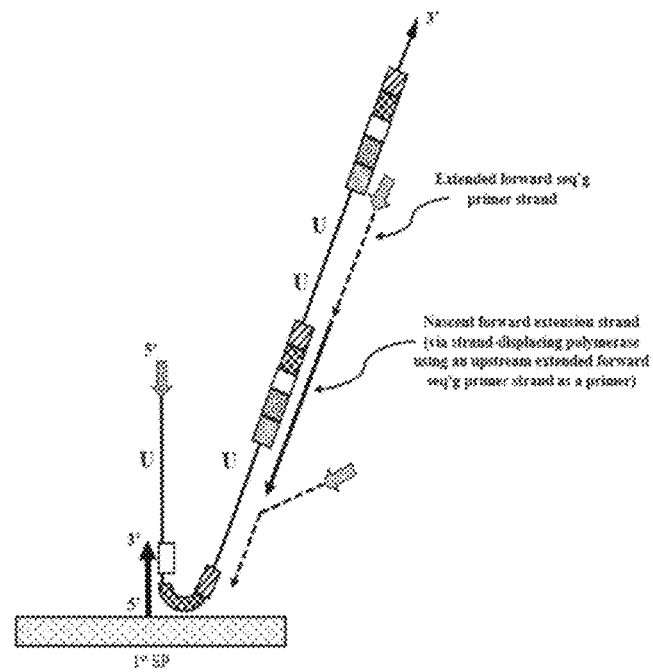

FIG. 43 is a schematic showing an exemplary method for replacing the extended forward sequencing primer strands by conducting a primer extension reaction with a strand displacing polymerase in the absence of a soluble primer.

Figure 44:
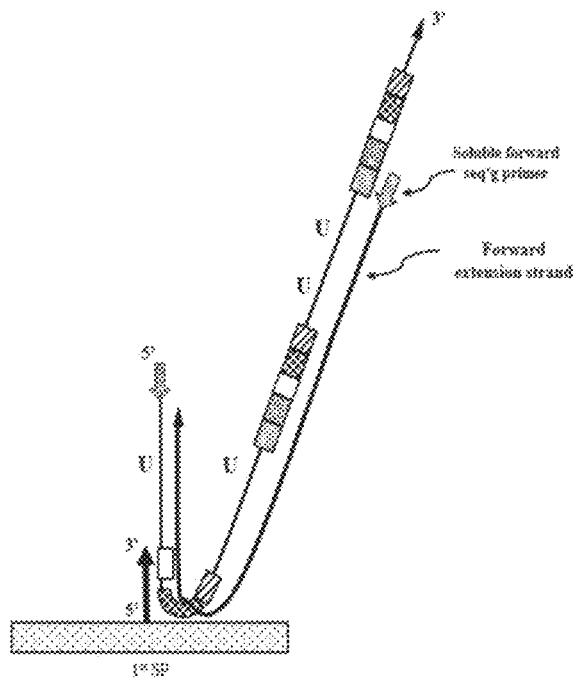

FIG. 44 is a schematic showing an exemplary method for replacing the extended forward sequencing primer strands by conducting a primer extension reaction with a soluble forward sequencing primer.

Figure 45:
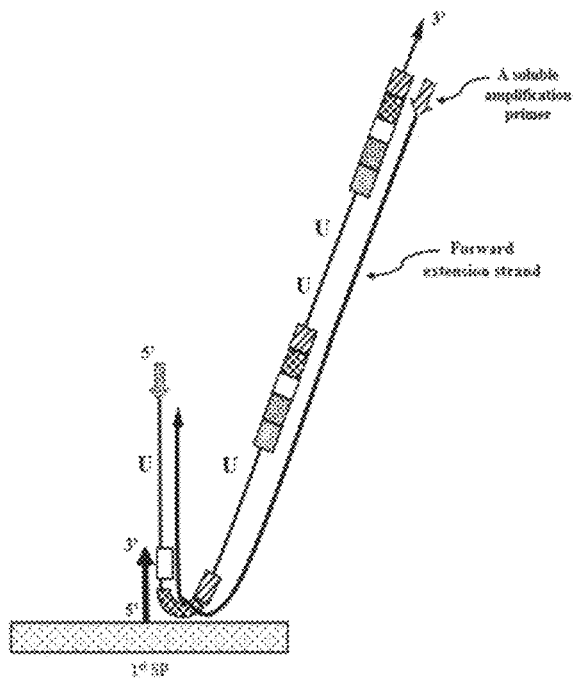

FIG. 45 is a schematic showing an exemplary method for replacing the extended forward sequencing primer strands by conducting a primer extension reaction with a soluble amplification primer.

FIG. 46 is a schematic showing an exemplary method for generating abasic sites in the immobilized single stranded concatemer template molecules at the nucleotides having the scissile moiety and generating gaps at the abasic sites to generate a plurality of gap-containing concatemer template molecules while retaining the plurality of forward extension strands and retaining the plurality of immobilized first surface primers. The forward extension strand can be generated by the method depicted in FIG. 43 or 44.

FIG. 47 is a schematic showing an exemplary retained forward extension strand after removal of the gap-containing concatemer template molecule as shown in FIG. 46.

FIG. 48 is a schematic showing an exemplary method for generating abasic sites in the immobilized single stranded concatemer template molecules at the nucleotides having the scissile moiety and generating gaps at the abasic sites to generate a plurality of gap-containing concatemer template molecules while retaining the plurality of forward extension strands and retaining the plurality of immobilized first surface primers. The forward extension strand can be generated by the method depicted in FIG. 45.

FIG. 49 is a schematic showing an exemplary retained forward extension strand after removal of the gap-containing concatemer template molecule as shown in FIG. 48.

Figure 50:
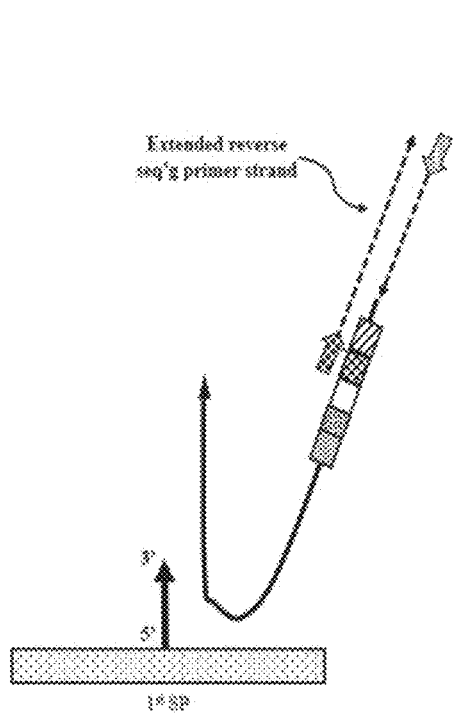

FIG. 50 is a schematic showing an exemplary reverse sequencing reaction conducted on the retained forward extension strand shown in FIG. 47. The reverse sequencing reaction can be conducted with a plurality of soluble reverse sequencing primers. The retained forward extension strand depicted in FIG. 50 is a concatemer molecule that can include two or more tandem copies of the sequence of interest and various primer binding sites. Such a concatemer molecule can have two or more extended reverse sequencing primer strands hybridized thereon. The extended reverse sequencing primer strands are not hybridized to the first surface primer, or covalently joined to the first surface primer. Therefore, the extended reverse sequencing primer strands are not immobilized to the support. For the sake of simplicity, FIGS. 41-50 show an exemplary immobilized concatemer molecule with one copy of the sequence of interest and various universal primer binding sites. The skilled artisan will appreciate that the immobilized concatemer molecule can include two or more tandem copies containing the sequence of interest and various universal primer binding sites.

Figure 51:
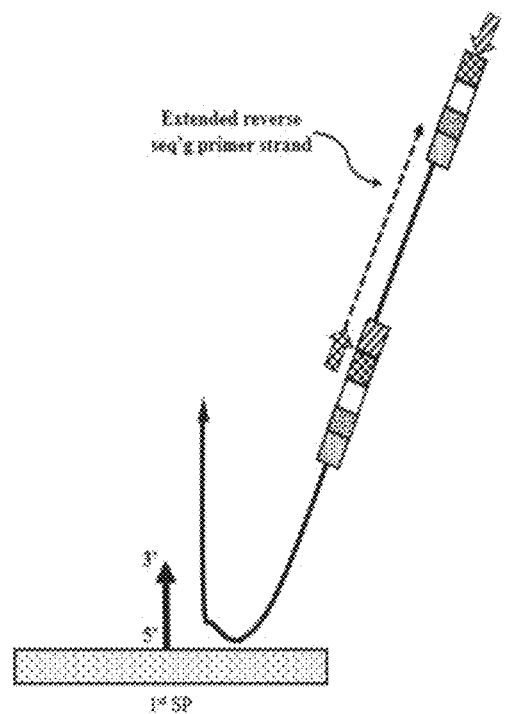

FIG. 51 is a schematic showing an exemplary reverse sequencing reaction conducted on the retained forward extension strand shown in FIG. 49. The retained forward extension strand can have two or more extended reverse sequencing primer strands hybridized thereon. The retained forward extension strand depicted in FIG. 51 is a concatemer molecule that includes two or more tandem copies of the sequence of interest and various primer binding sites. Such a concatemer molecule can have two or more extended reverse sequencing primer strands hybridized thereon. The extended reverse sequencing primer strands are not hybridized to the first surface primer, or covalently joined to the first surface primer. Therefore, the extended reverse sequencing primer strands are not immobilized to the support. For the sake of simplicity, FIGS. 41-51 show an exemplary immobilized concatemer molecule with two tandem copies containing the sequence of interest and various universal primer binding sites. The skilled artisan will appreciate that the immobilized concatemer molecule can include three or more tandem copies containing the sequence of interest and various universal primer binding sites.

Figure 41:
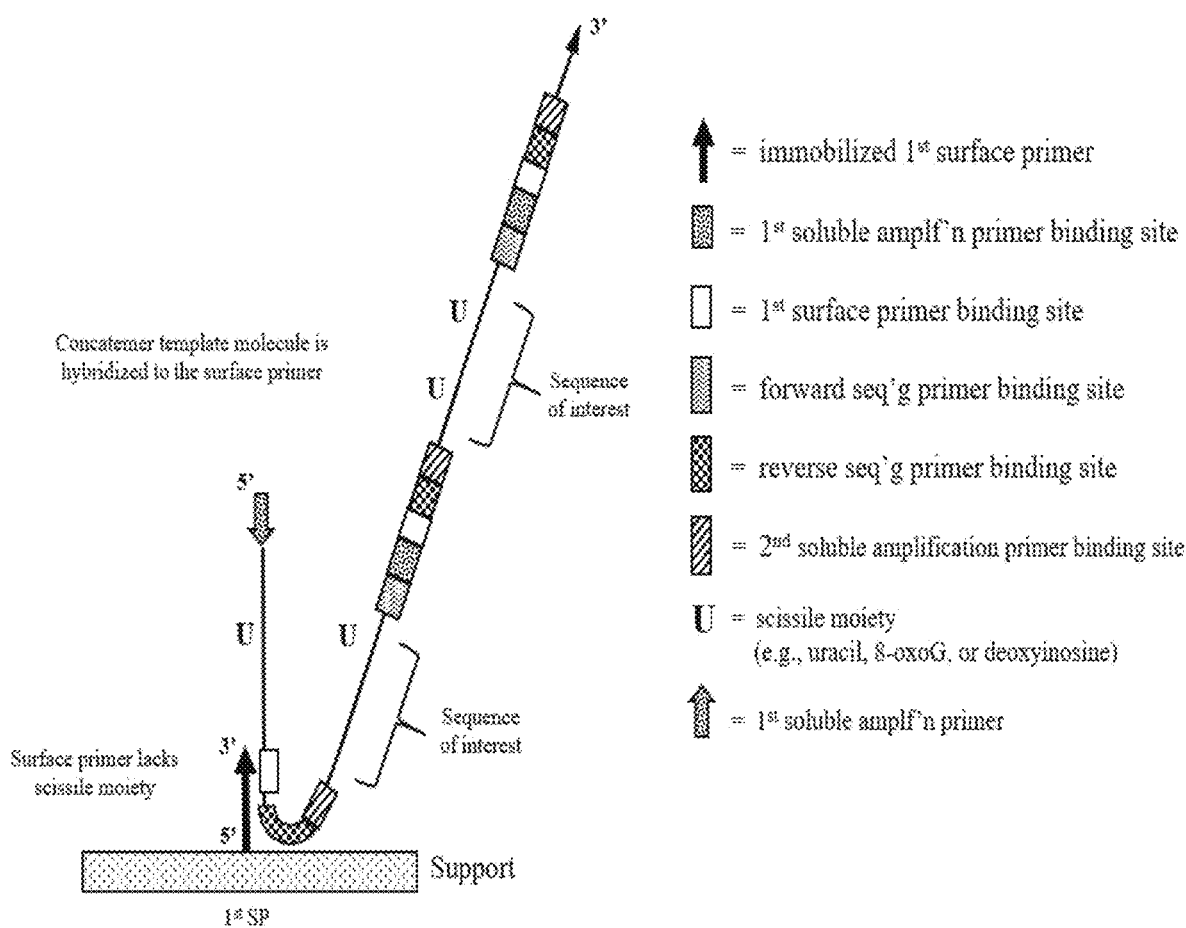
Figure 52:
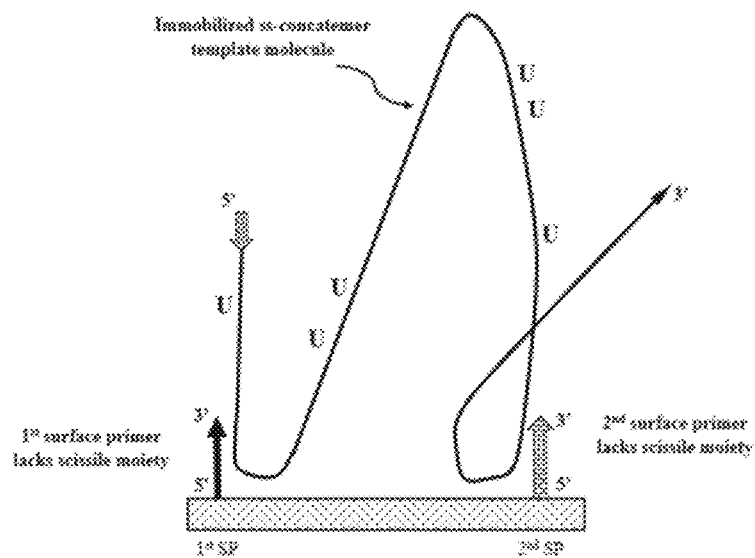

FIG. 52 is a schematic showing an exemplary support having a first and second surface primers immobilized thereon. A portion of the immobilized concatemer template molecule shown in FIG. 41 is hybridized to the immobilized second surface primer. The immobilized concatemer template molecule has two or more copies of a universal binding sequence for an immobilized second surface primer. The portion of the immobilized concatemer template molecule that includes the universal binding sequence for an immobilized second surface primer can hybridize to the immobilized second surface primer.

Figure 53:
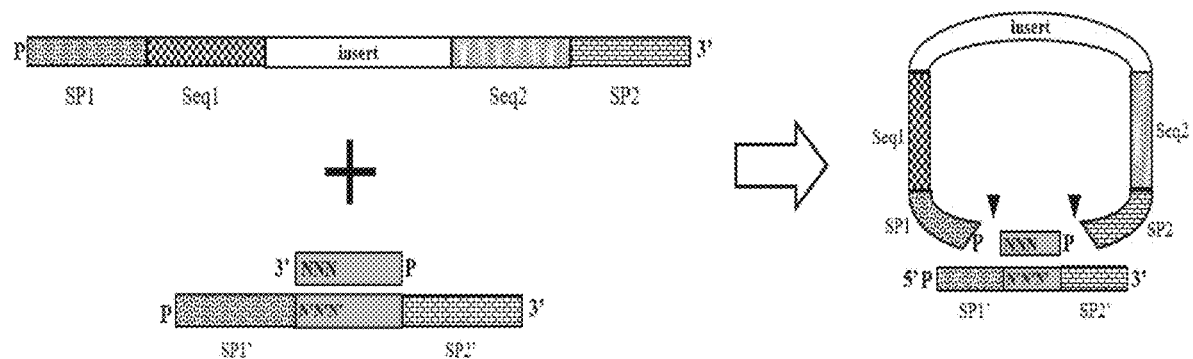

FIG. 53 is schematic showing a linear single stranded library molecule (left top schematic) hybridizing with a double stranded splint molecule (left bottom schematic) to generate a circular library molecule with two gaps (right schematic). The splint molecule comprises a first splint strand (long strand) hybridized to a second splint strand (short strand). The first splint strand comprises a left sequence that hybridizes with a sequence on one end of the linear single stranded library molecule, and a right sequence that hybridizes with a sequence on the other end of the linear single stranded library molecule. The interior portion of the first splint strand hybridizes to the second splint strand.

Figure 54:
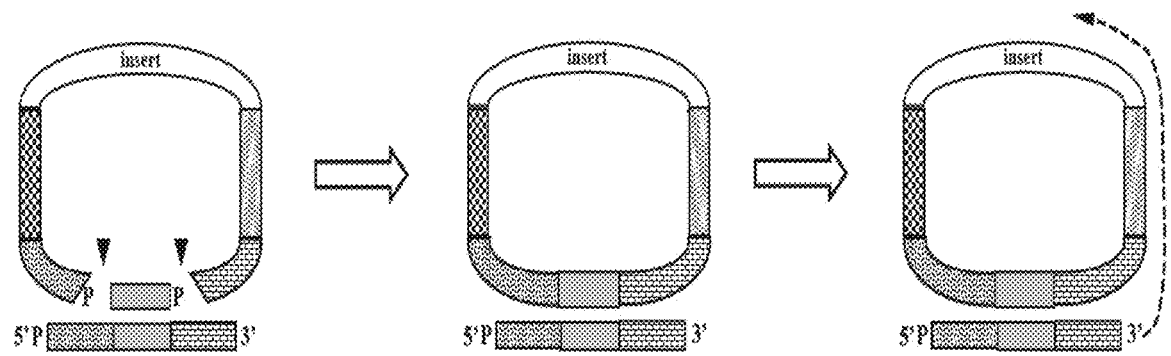

FIG. 54 is a schematic showing the circular library molecule (left schematic) which is shown in FIG. 53 undergoing a ligation reaction to generate a single stranded covalently closed circular molecule which is hybridized to the first splint strand (center schematic). The single stranded covalently closed circular molecule is subjected to a rolling circle amplification reaction using the 3' end of the first splint strand to initiate the RCA reaction (right schematic).

Figure 55:
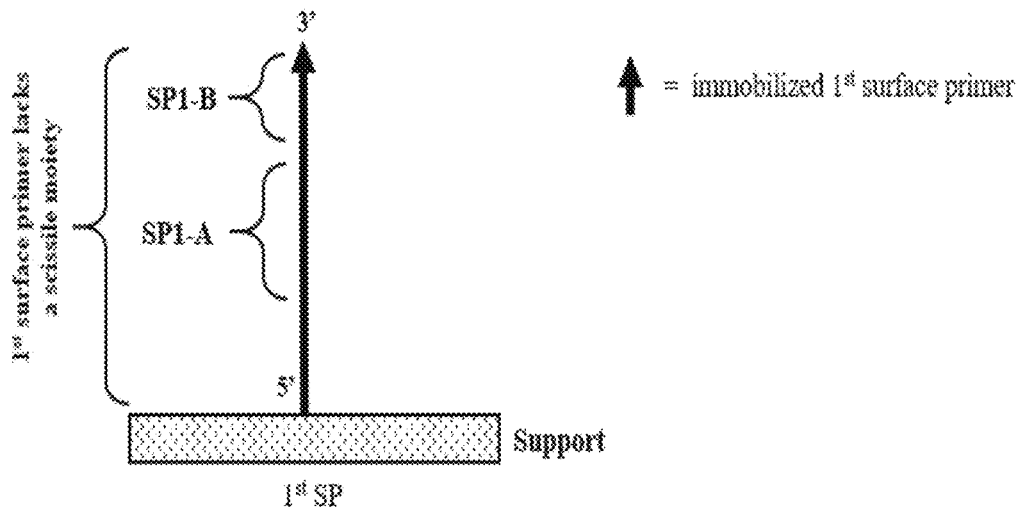

FIG. 55 is a schematic showing an exemplary support having a first surface primer immobilized thereon, which in some embodiments, can be used to conduct an on-support ligation reaction for a pairwise sequencing workflow. FIGS. 55-72 show the workflow of on-support ligation and pairwise sequencing.

Figure 56:
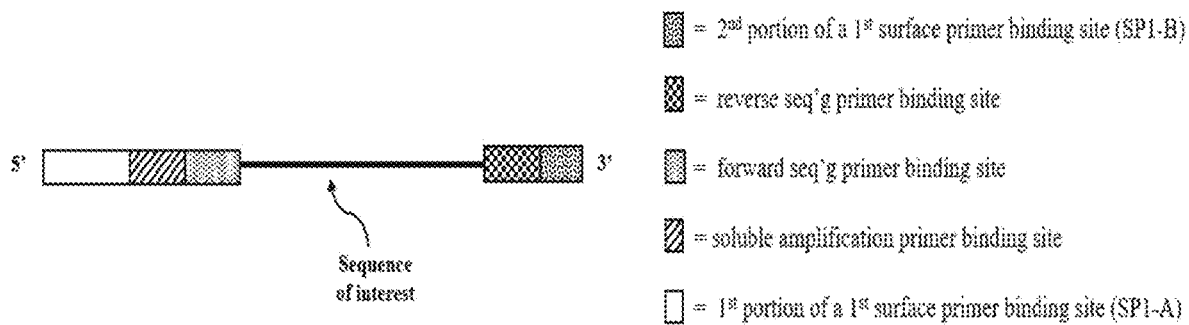

FIG. 56 is a schematic showing an exemplary single stranded linear library molecule comprising a sequence of interest and various universal adaptor sequences for primer binding sites. The arrangement of the various universal adaptor sequences in this schematic is for illustration purposes. The skilled artisan will appreciate that many other arrangements, and combinations of universal adaptor sequences, are possible.

Figure 57:
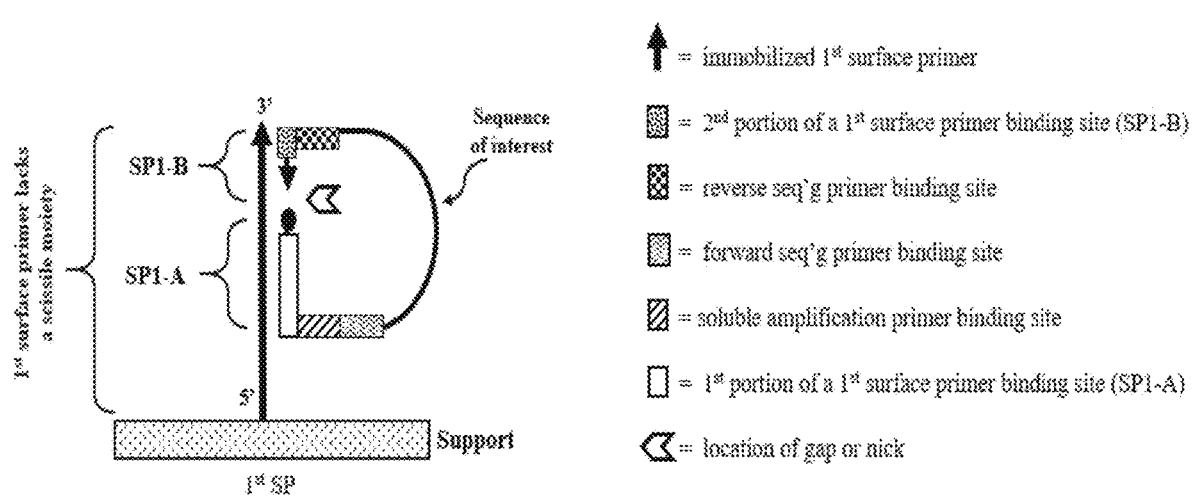

FIG. 57 is a schematic showing an exemplary single stranded linear library molecule hybridized to an immobilized first surface primer to form a circularized library molecule having an asymmetrically positioned gap or nick.

Figure 58:
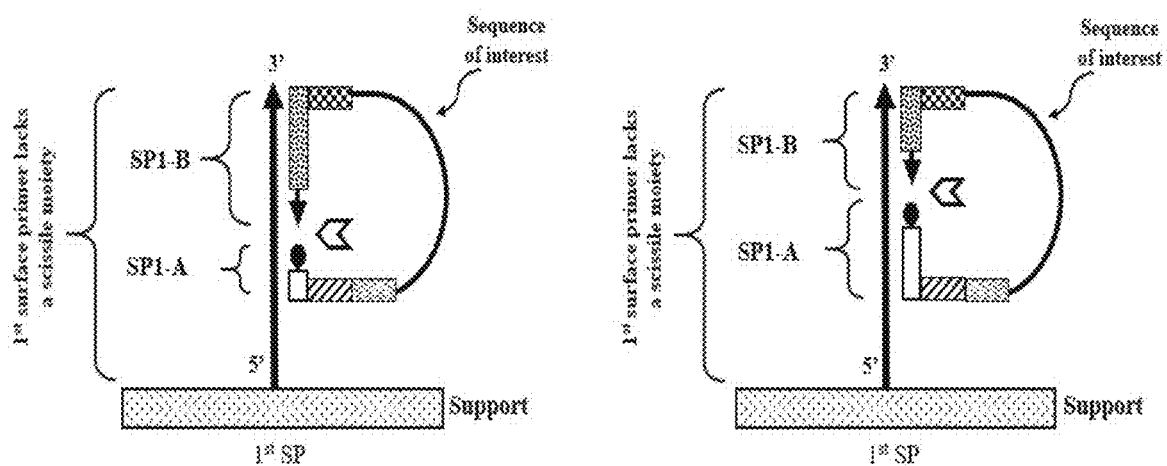

FIG. 58 (left) is a schematic showing an exemplary single stranded linear library molecule hybridized to an immobilized first surface primer to form a circularized library molecule having an asymmetrically positioned gap or nick. FIG. 58 (right) is a schematic showing an exemplary single stranded linear library molecule hybridized to an immobilized first surface primer to form a circularized library molecule having a symmetrically positioned gap or nick. The schematics shown in FIGS. 57 and 58 represent several embodiments of a circularized library molecule comprising a single stranded linear library molecule hybridized to an immobilized first surface primer.

Figure 59:
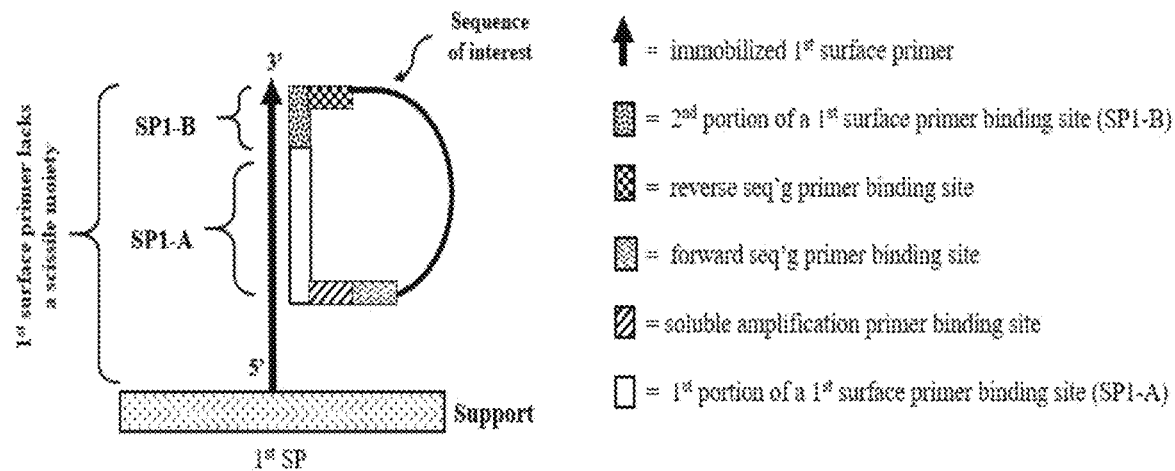

FIG. 59 is a schematic showing an exemplary covalently closed circular library molecule generated by covalently closing the gap or nick.

Figure 60:
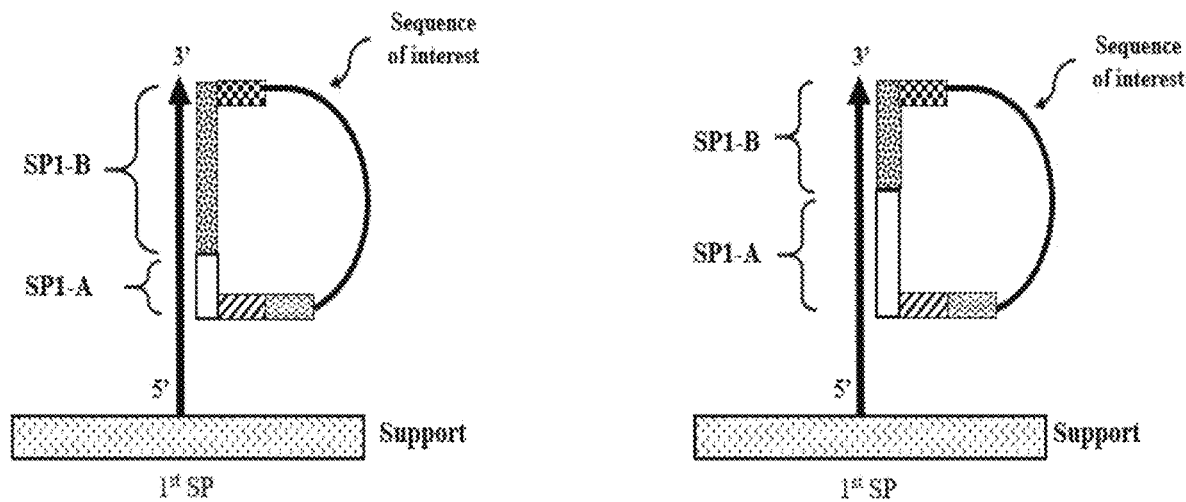

FIG. 60 (left) is a schematic showing an exemplary covalently closed circular library molecule generated by covalently closing the gap or nick. FIG. 60 (right) is a schematic showing an exemplary covalently closed circular library molecule generated by covalently closing the gap or nick. The schematics shown in FIGS. 57 and 58 represent several embodiments of a covalently closed circular library molecule hybridized to an immobilized first surface primer.

Figure 61:
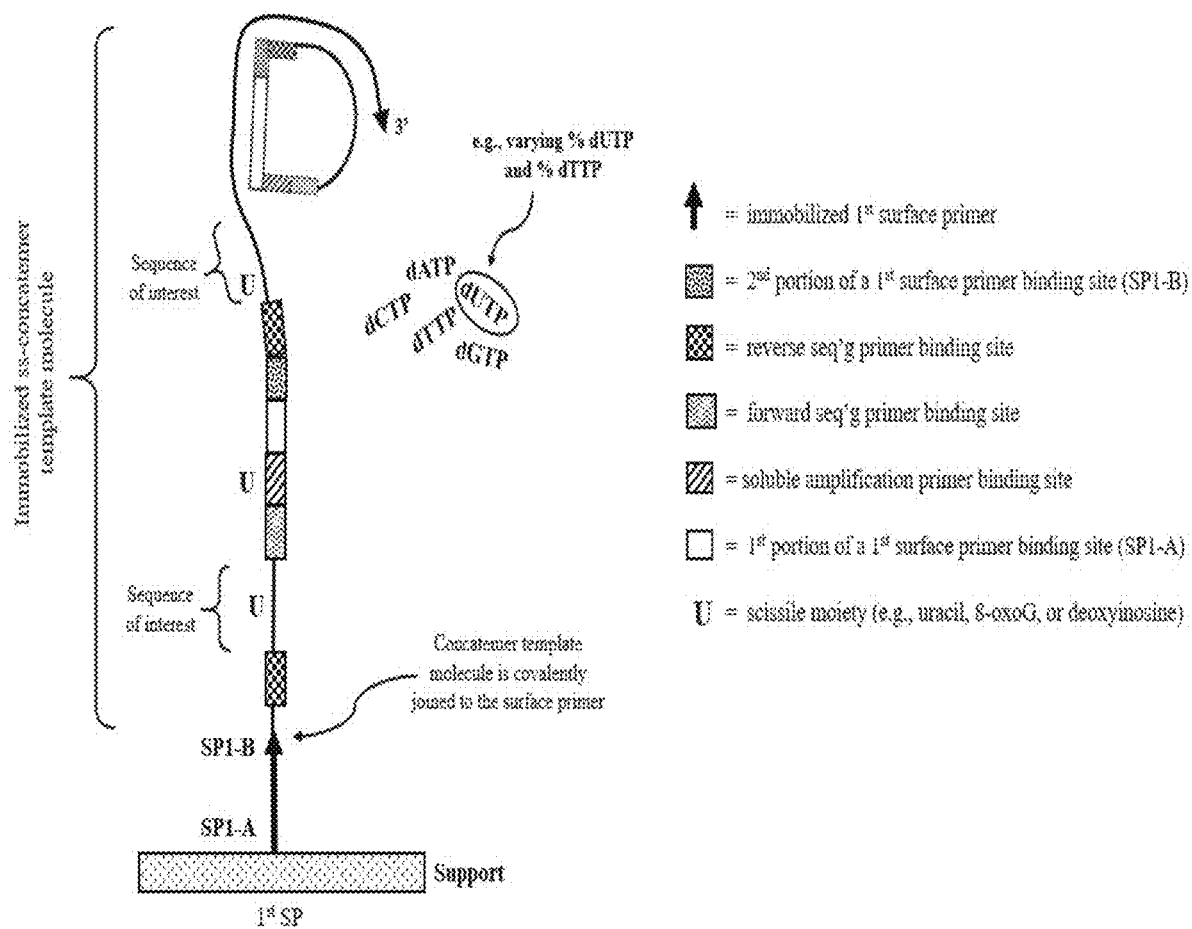

FIG. 61 is a schematic showing an exemplary on-support rolling circle amplification reaction using a covalently closed circular library molecule, the immobilized first surface primer shown in FIG. 55, and a mixture of nucleotides including nucleotides having a scissile moiety that can be cleaved to generate an abasic site. The rolling circle amplification reaction generates an immobilized single stranded nucleic acid concatemer template molecule having at least one nucleotide with a scissile moiety which can be cleaved to generate an abasic site in the immobilized concatemer template molecule.

Figure 62:
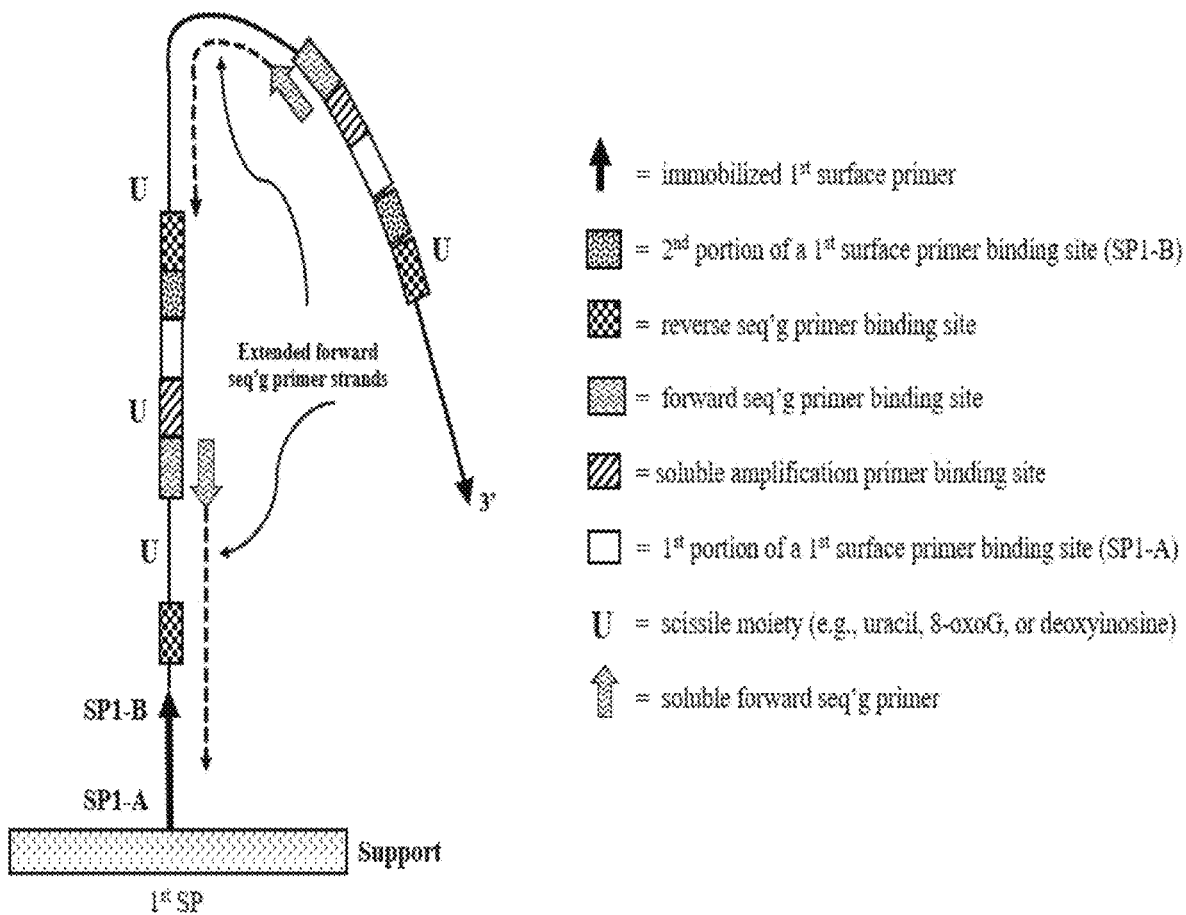

FIG. 62 is a schematic showing an exemplary forward sequencing reaction conducted on the immobilized concatemer template molecule shown in FIG. 61. The forward sequencing reaction can be conducted with a plurality of soluble forward sequencing primers and generates a plurality of extended forward sequencing primer strands. The immobilized concatemer template molecule can have two or more extended forward sequencing primer strands hybridized thereon.

Figure 63:
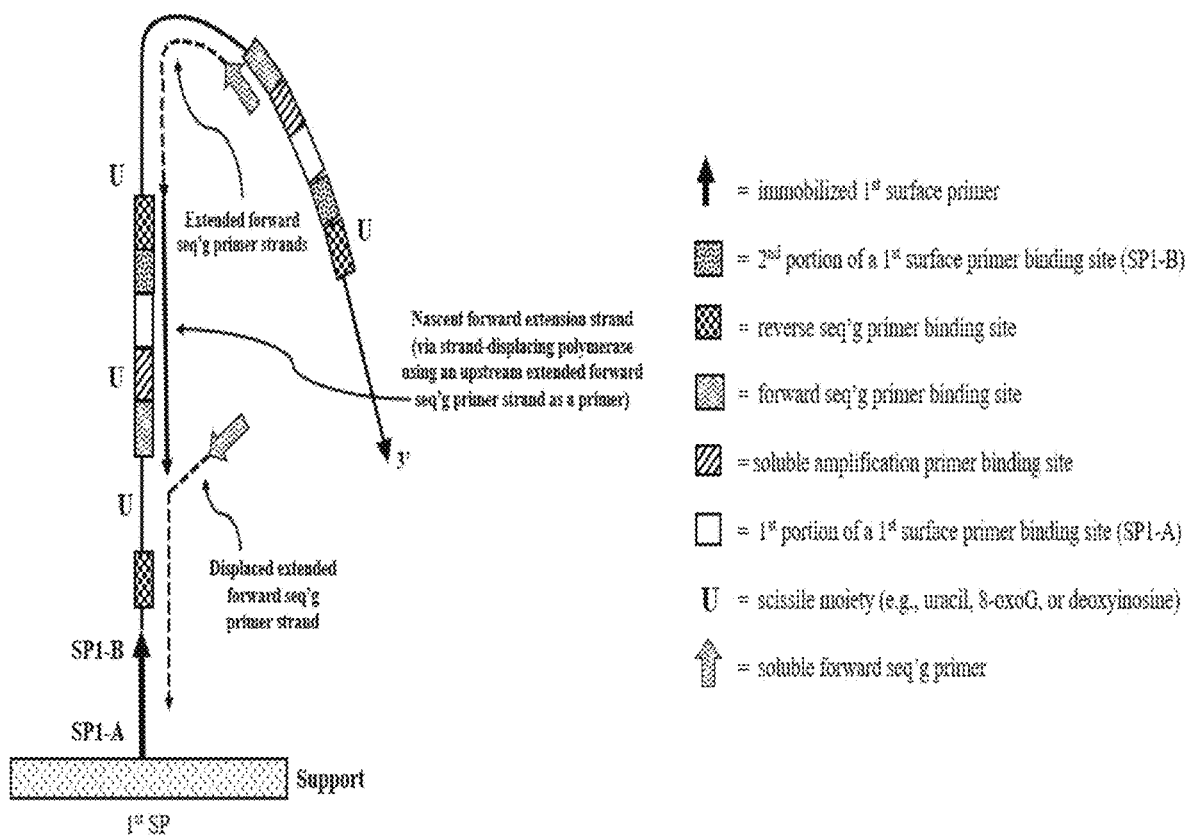

FIG. 63 is a schematic showing an exemplary method for replacing the extended forward sequencing primer strands by conducting a primer extension reaction with a strand displacing polymerase in the absence of a soluble primer thereby generating a forward extension strand.

Figure 64:
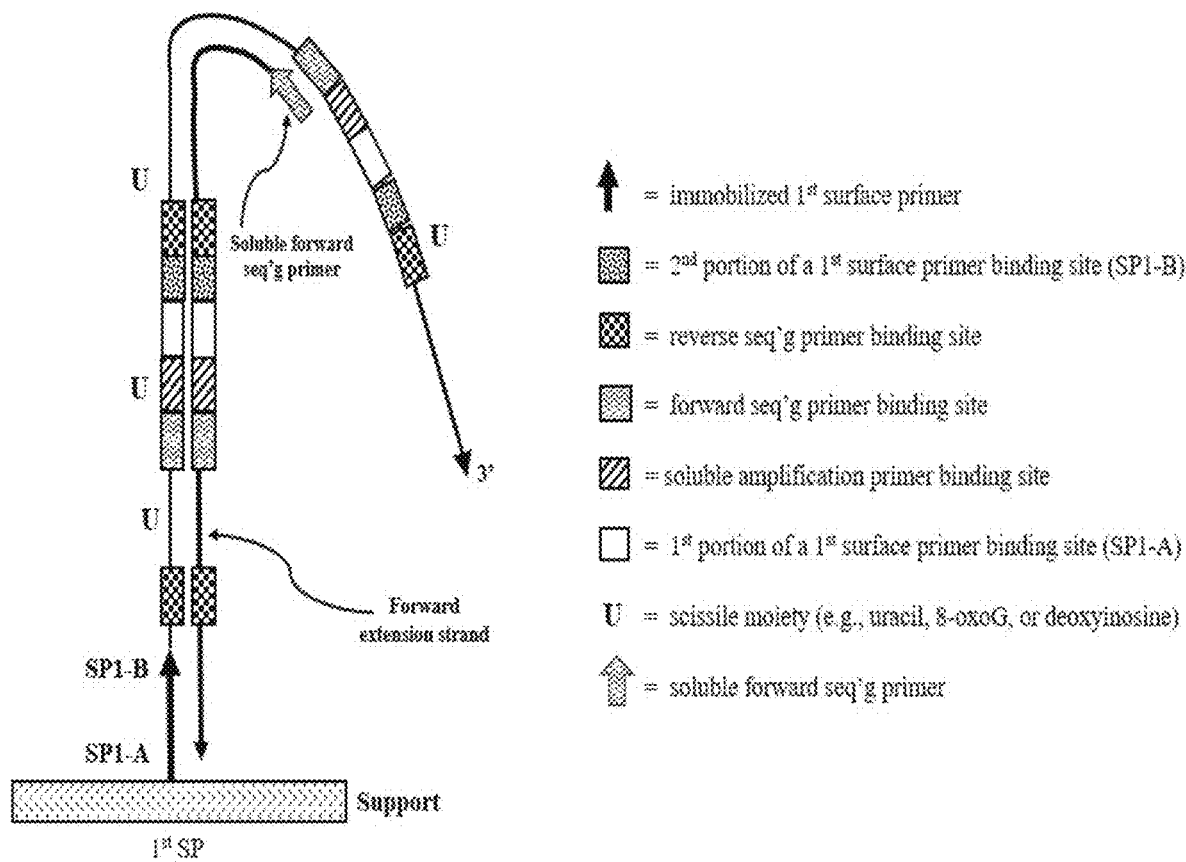

FIG. 64 is a schematic showing an exemplary method for replacing the extended forward sequencing primer strands by conducting a primer extension reaction with a soluble forward sequencing primer thereby generating a forward extension strand.

Figure 65:
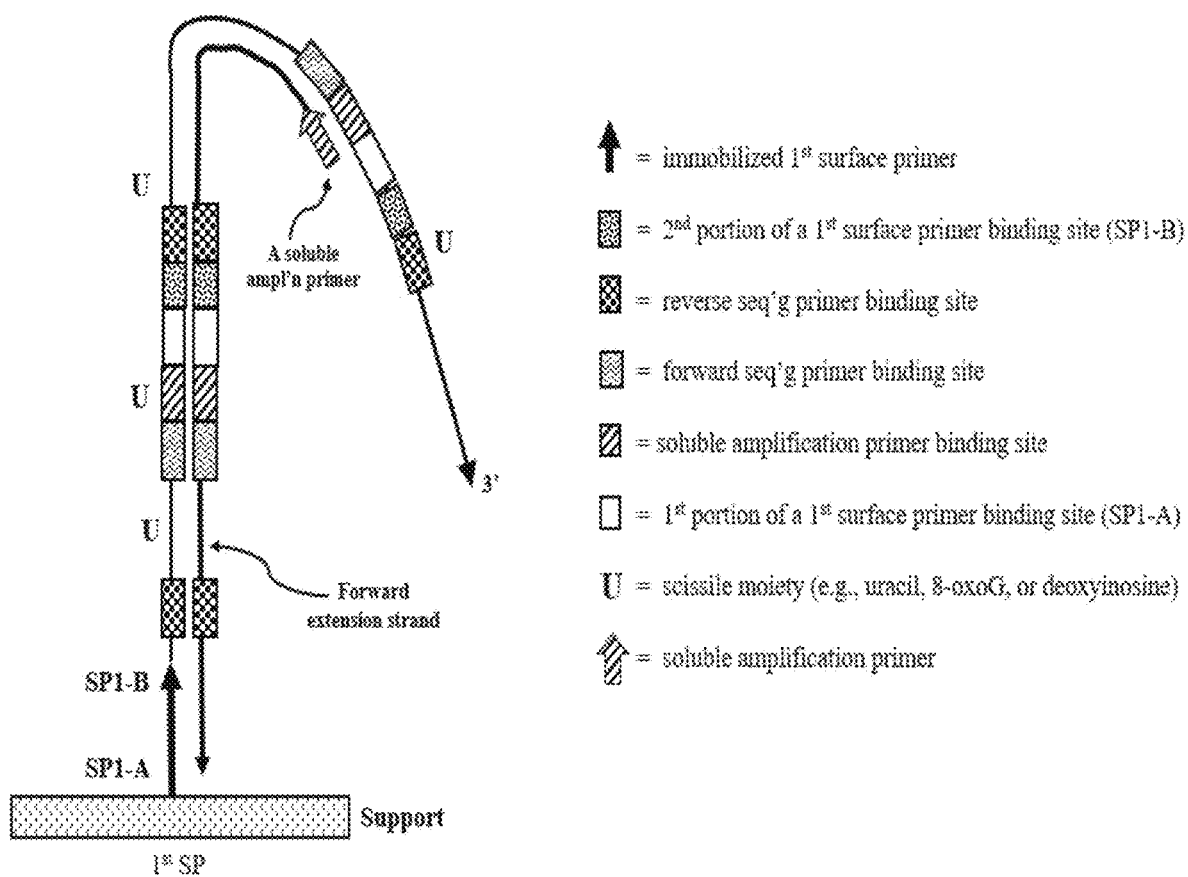

FIG. 65 is a schematic showing an exemplary method for replacing the extended forward sequencing primer strands by conducting a primer extension reaction with a soluble amplification primer thereby generating a forward extension strand.

Figure 66:
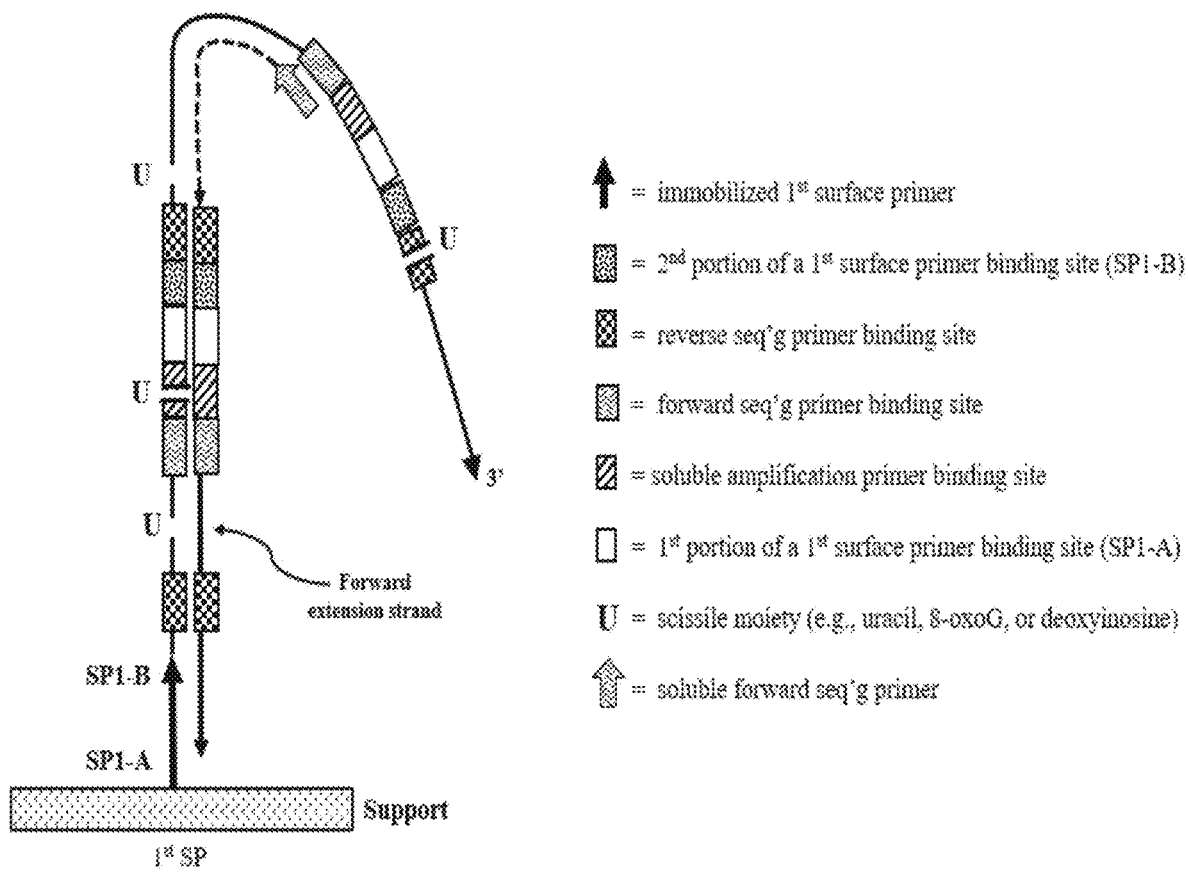

FIG. 66 is a schematic showing an exemplary method for generating abasic sites in the immobilized single stranded concatemer template molecules at the nucleotides having the scissile moiety and generating gaps at the abasic sites to generate a plurality of gap-containing concatemer template molecules while retaining the plurality of forward extension strands and retaining the plurality of immobilized first surface primers. The forward extension strand can be generated by the method depicted in FIG. 63 or 64.

Figure 67:
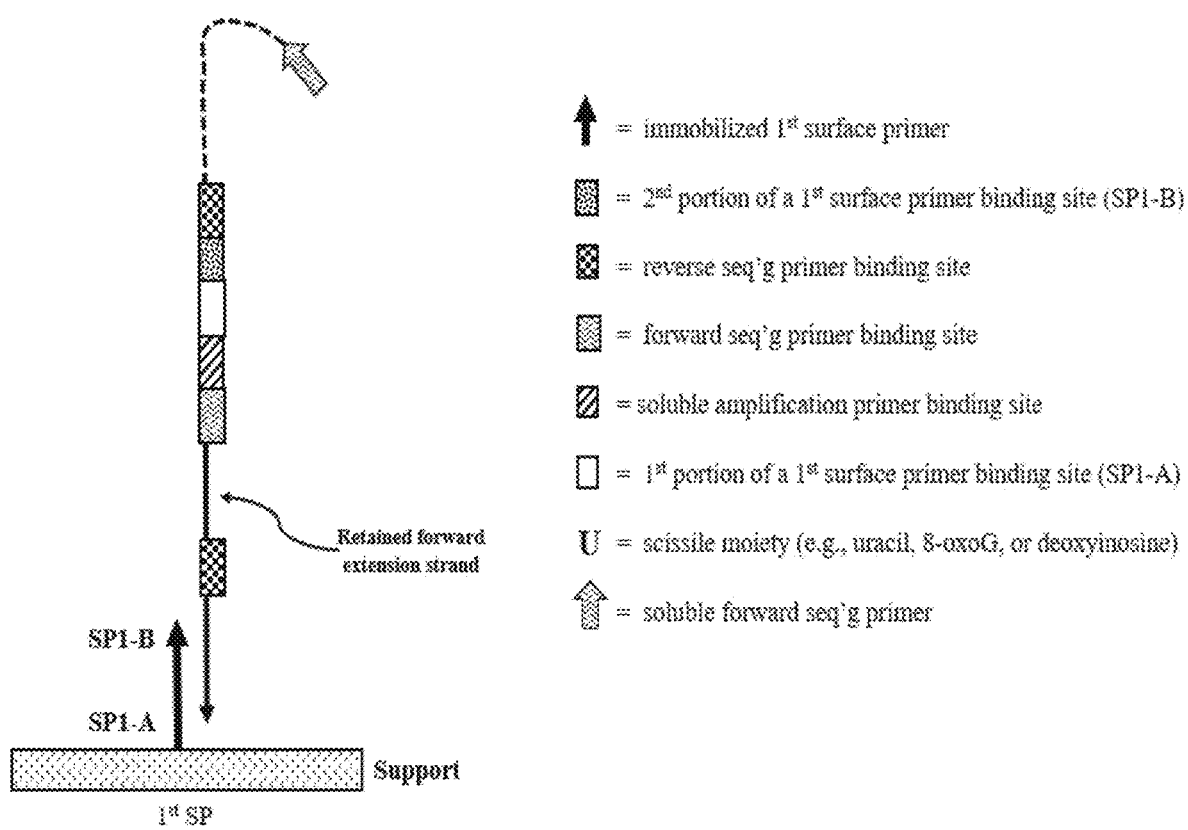

FIG. 67 is a schematic showing an exemplary retained forward extension strand after removal of the gap-containing concatemer template molecule as shown in FIG. 66.

Figure 68:
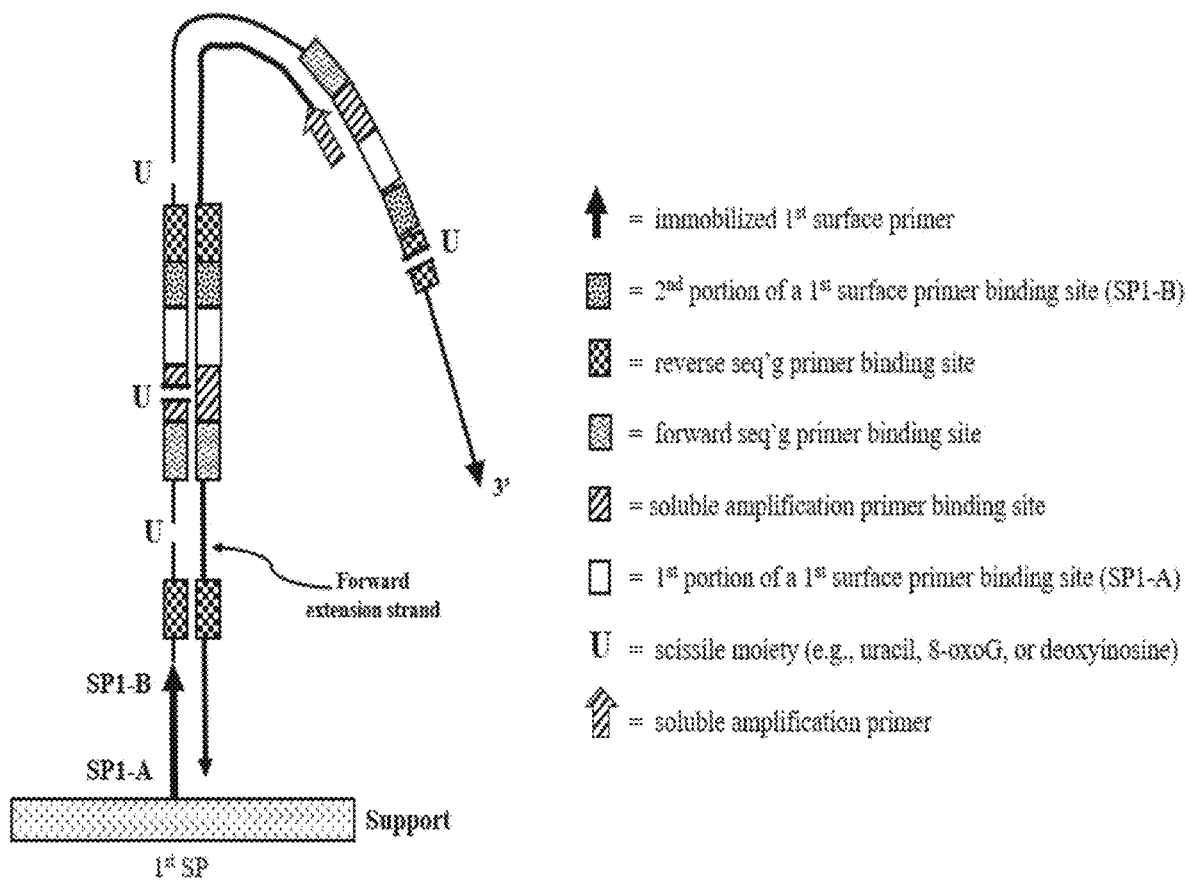

FIG. 68 is a schematic showing an exemplary method for generating abasic sites in the immobilized single stranded concatemer template molecules at the nucleotides having the scissile moiety and generating gaps at the abasic sites to generate a plurality of gap-containing concatemer template molecules while retaining the plurality of forward extension strands and retaining the plurality of immobilized first surface primers. The forward extension strand can be generated by the method depicted in FIG. 65.

Figure 69:
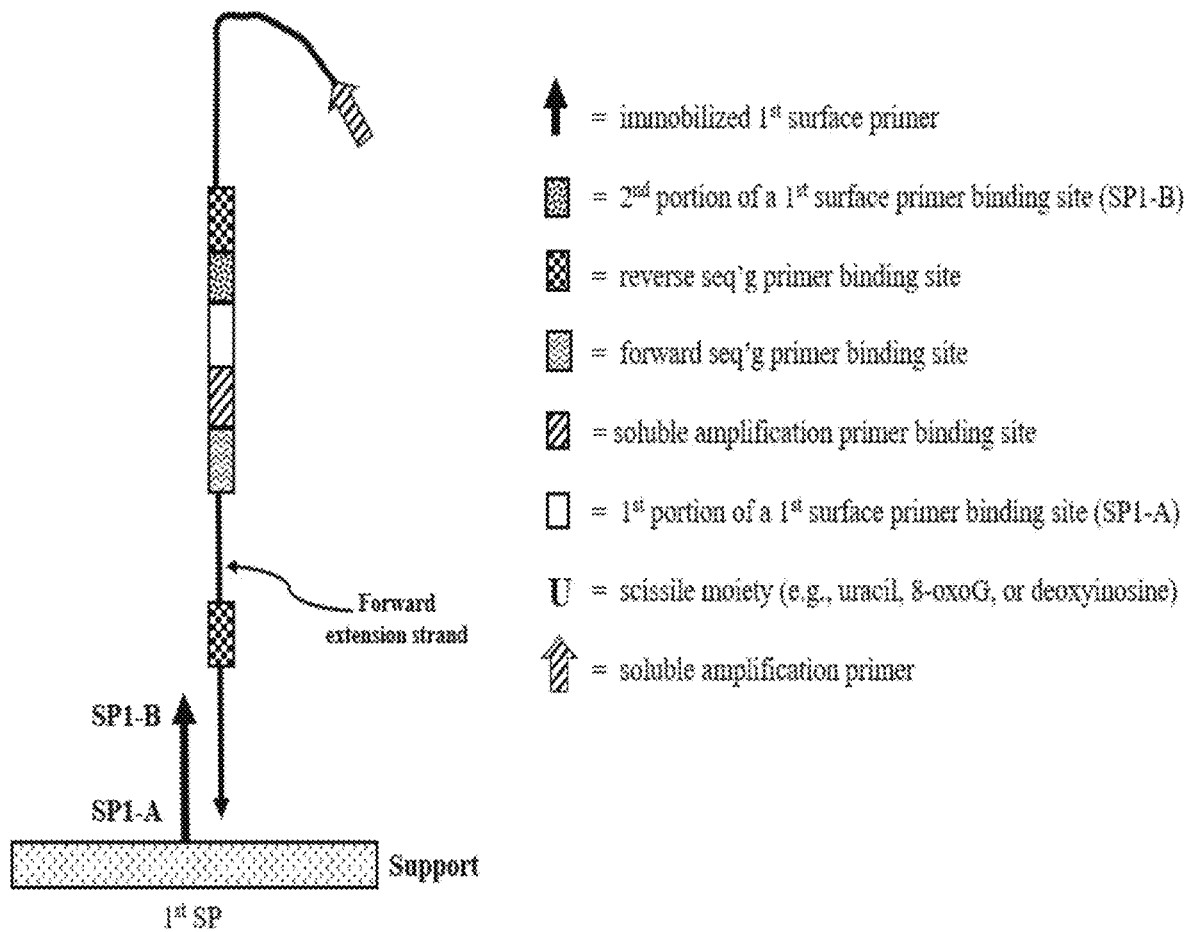

FIG. 69 is a schematic showing an exemplary retained forward extension strand after removal of the gap-containing concatemer template molecule as shown in FIG. 68.

Figure 70:
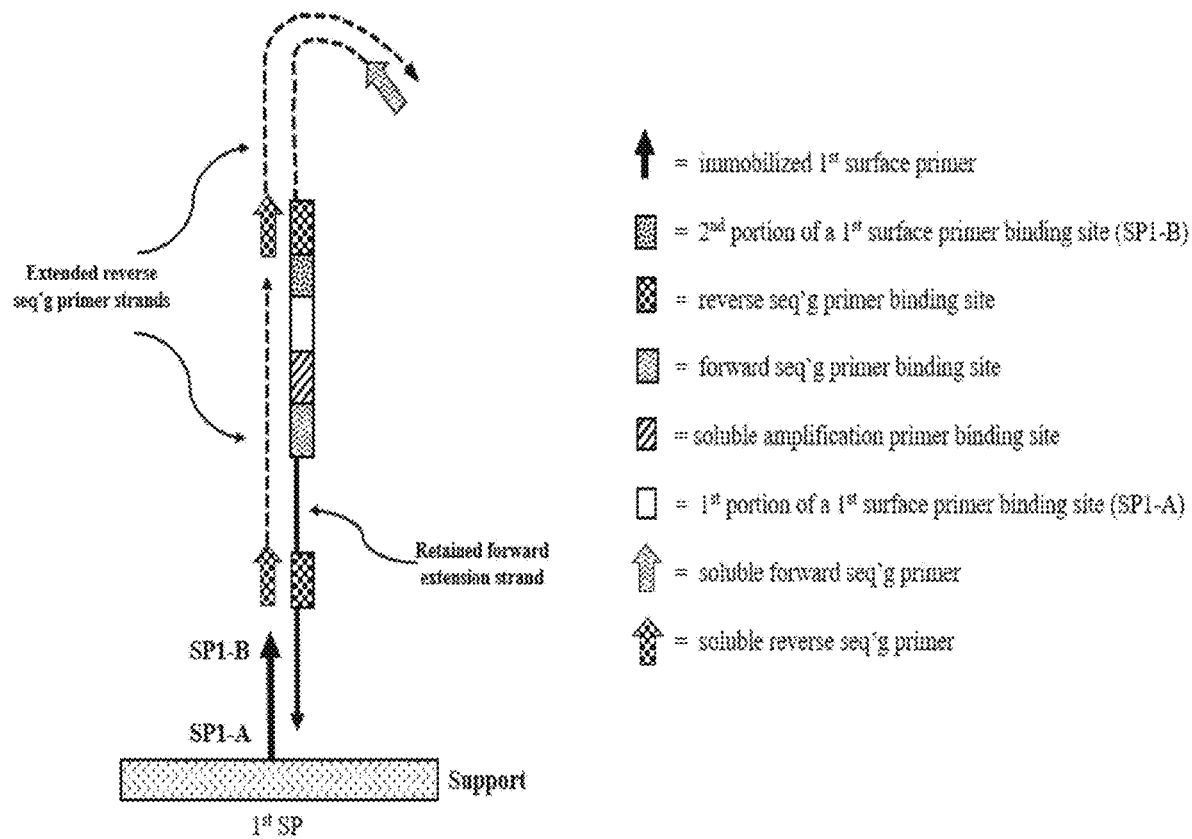

FIG. 70 is a schematic showing an exemplary reverse sequencing reaction conducted on the retained forward extension strand shown in FIG. 67. The reverse sequencing reaction can be conducted with a plurality of soluble reverse sequencing primers. The retained forward extension strand can have two or more extended reverse sequencing primer strands hybridized thereon. The extended reverse sequencing primer strands are not hybridized to the first surface primer, or covalently joined to the first surface primer. Therefore, the extended reverse sequencing primer strands are not immobilized to the support.

Figure 71:
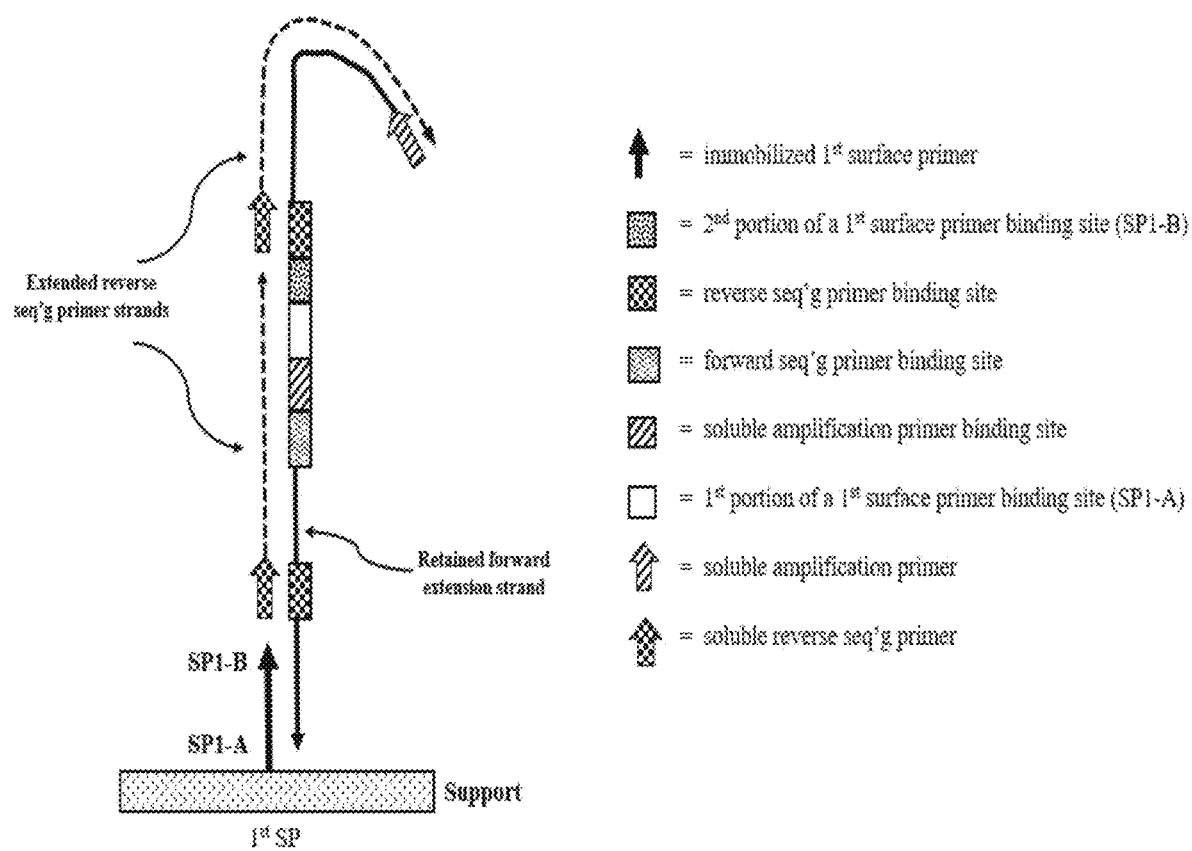

FIG. 71 is a schematic showing an exemplary reverse sequencing reaction conducted on the retained forward extension strand shown in FIG. 69. The retained forward extension strand can have two or more extended reverse sequencing primer strands hybridized thereon. The extended reverse sequencing primer strands are not hybridized to the first surface primer, or covalently joined to the first surface primer. Therefore, the extended reverse sequencing primer strands are not immobilized to the support.

Figure 72:
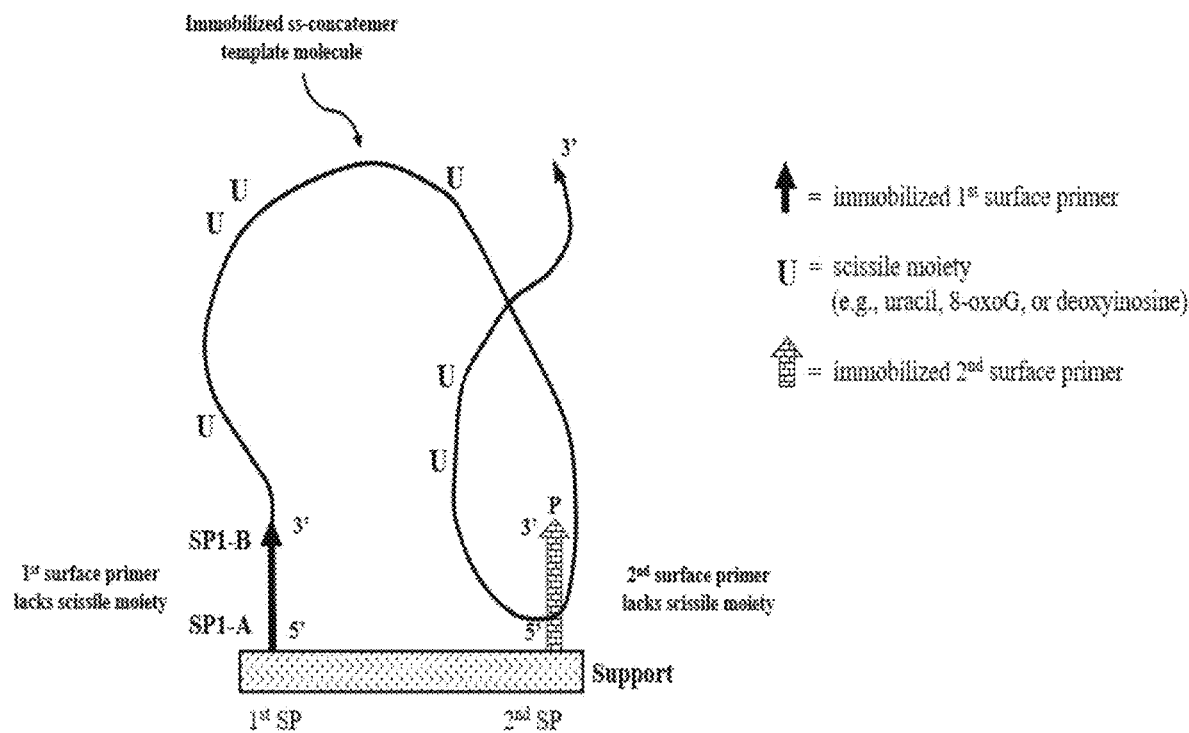

FIG. 72 is a schematic showing an exemplary support having a first and second surface primers immobilized thereon. A portion of the immobilized concatemer template molecule shown in FIG. 61 is hybridized to the immobilized second surface primer. The immobilized concatemer template molecule has two or more copies of a universal binding sequence for an immobilized second surface primer. The portion of the immobilized concatemer template molecule that includes the universal binding sequence for an immobilized second surface primer can hybridize to the immobilized second surface primer.

Figure 73:
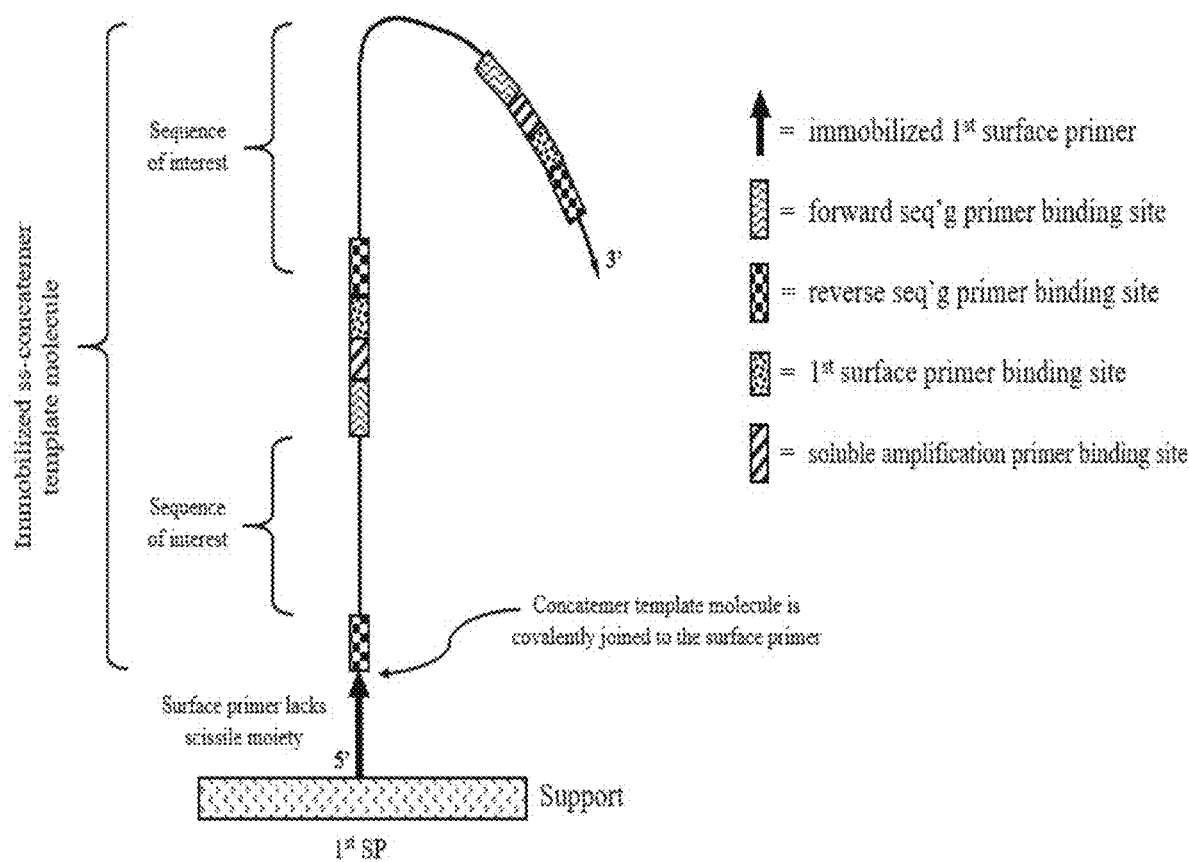

FIG. 73 is a schematic showing an exemplary single stranded nucleic acid concatemer template molecule immobilized to an immobilized first surface primer. In some embodiments, the immobilized concatemer template molecule can be generated by conducting an on-support rolling circle amplification reaction. The arrangement of the various primer binding sequences is for illustration purposes. The skilled artisan will appreciate that many other arrangements are possible. FIGS. 73-79 show the workflow of pairwise sequencing the immobilized concatemer template molecule depicted in FIG. 73.

Figure 74:
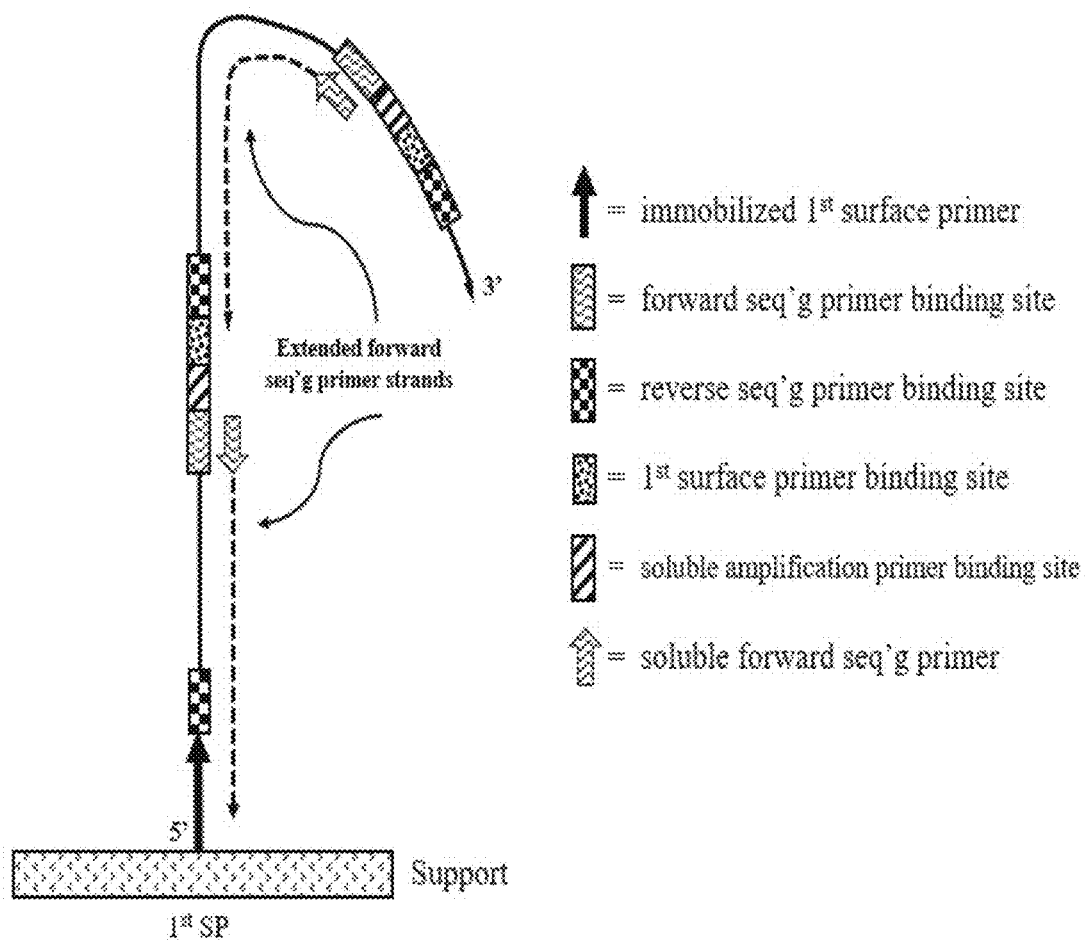

FIG. 74 is a schematic showing an exemplary forward sequencing reaction conducted on the immobilized concatemer template molecule shown in FIG. 73. The forward sequencing reaction can be conducted with a plurality of soluble forward sequencing primers and generates a plurality of extended forward sequencing primer strands. The immobilized concatemer template molecule can have two or more extended forward sequencing primer strands hybridized thereon.

Figure 75:
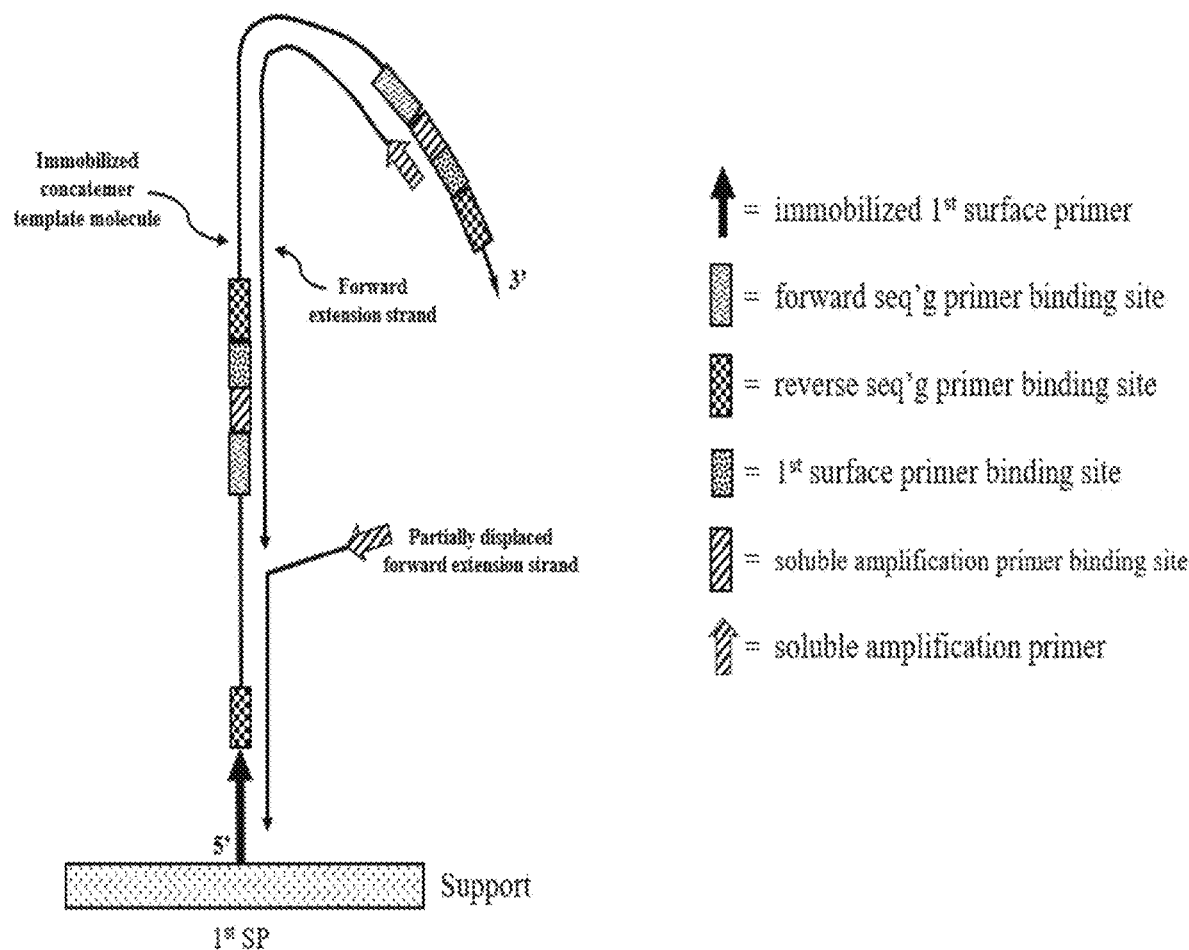

FIG. 75 is a schematic showing an exemplary method for replacing the extended forward sequencing primer strands by conducting a primer extension reaction with soluble amplification primers and strand displacing polymerases in the presence of compaction oligonucleotides, thereby generating a forward extension strand and a partially displaced forward extension strand which are hybridized to the immobilized concatemer template molecule thereby forming an immobilized amplicon.

Figure 76:
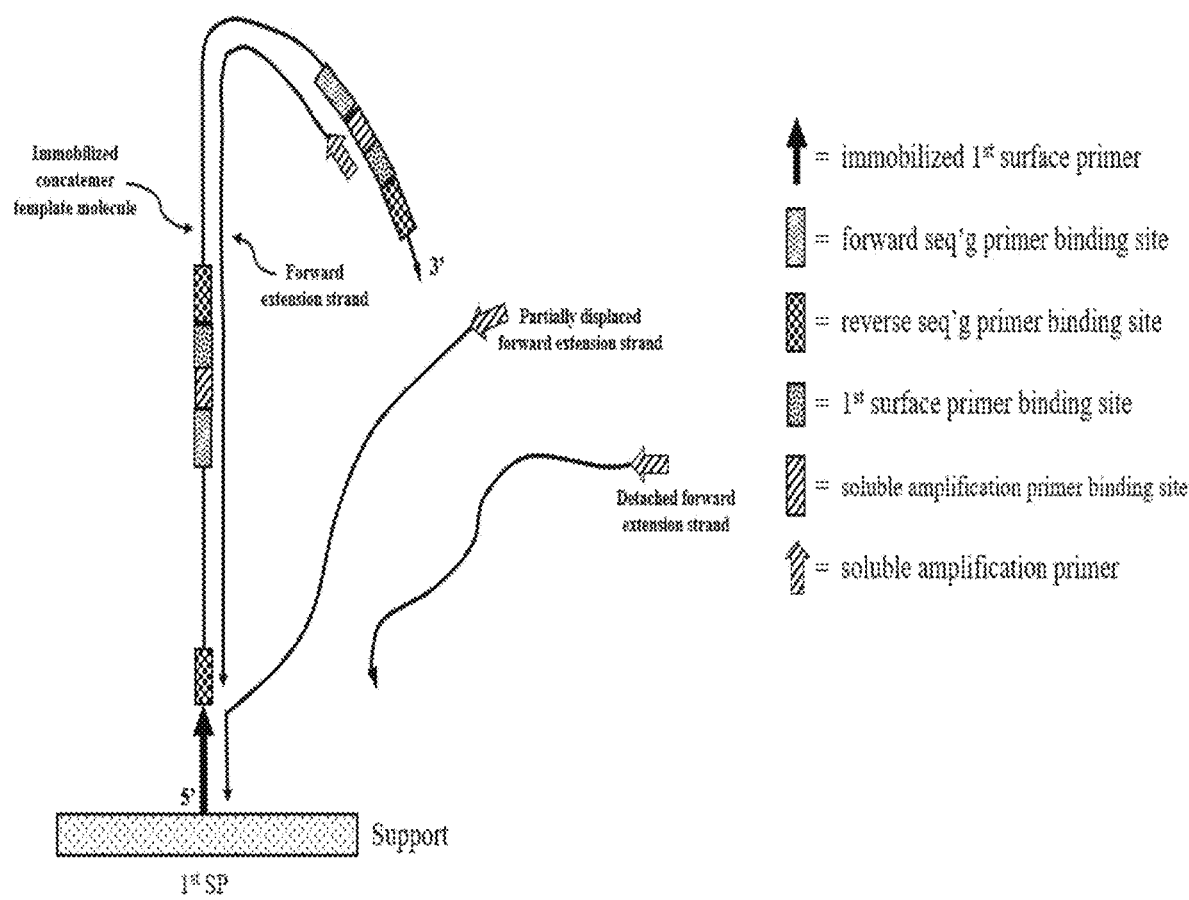

FIG. 76 is a schematic showing a continuation of the exemplary strand displacing method shown in FIG. 75, where the polymerase-catalyzed strand displacing reaction generates a forward extension strand and a partially displaced forward extension strand which are hybridized to the immobilized concatemer template molecule, and a detached forward extension strand which is not hybridized to the immobilized concatemer template molecule.

Figure 77:
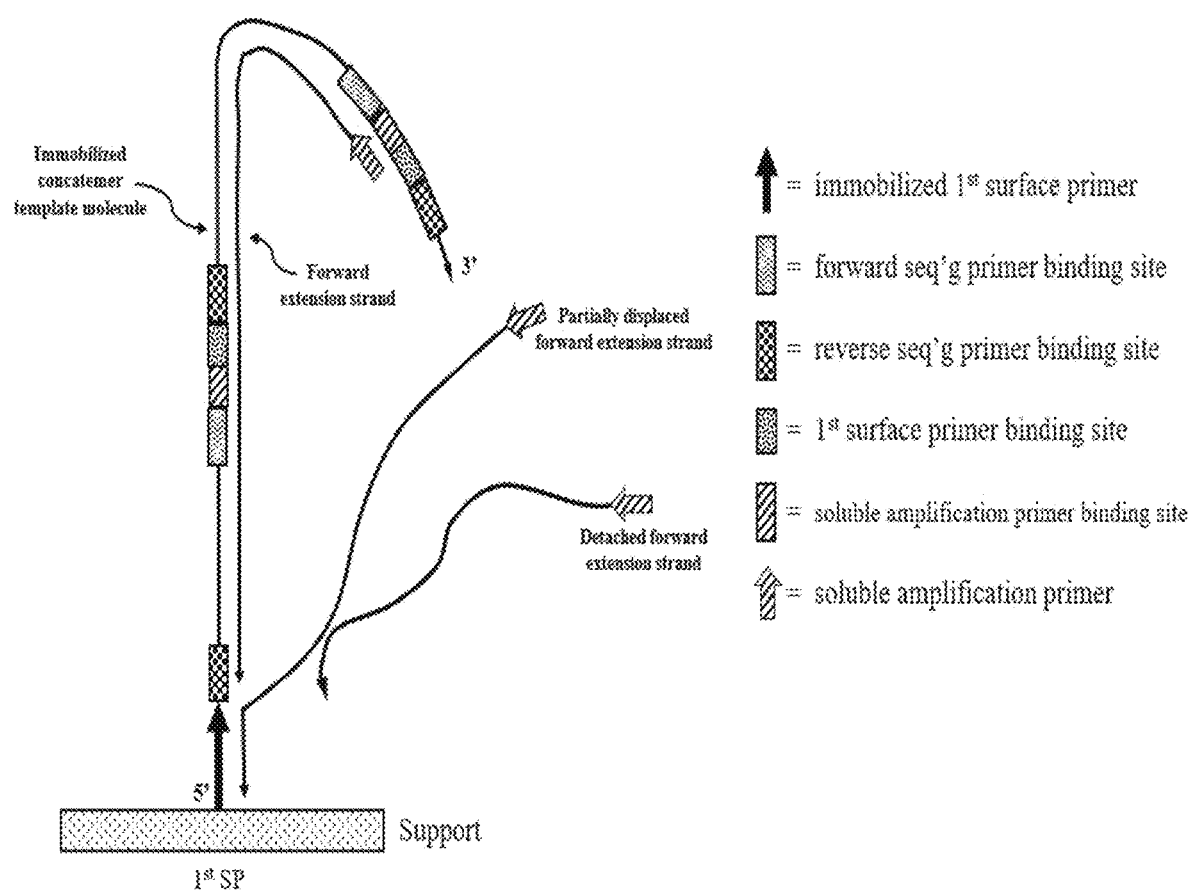

FIG. 77 is a schematic showing an exemplary hybridization complex comprising a forward extension strand and a partially displaced forward extension strand which are hybridized to the immobilized concatemer template molecule, and an immobilized detached forward extension strand which is hybridized to the partially displaced forward extension strand.

Figure 78:
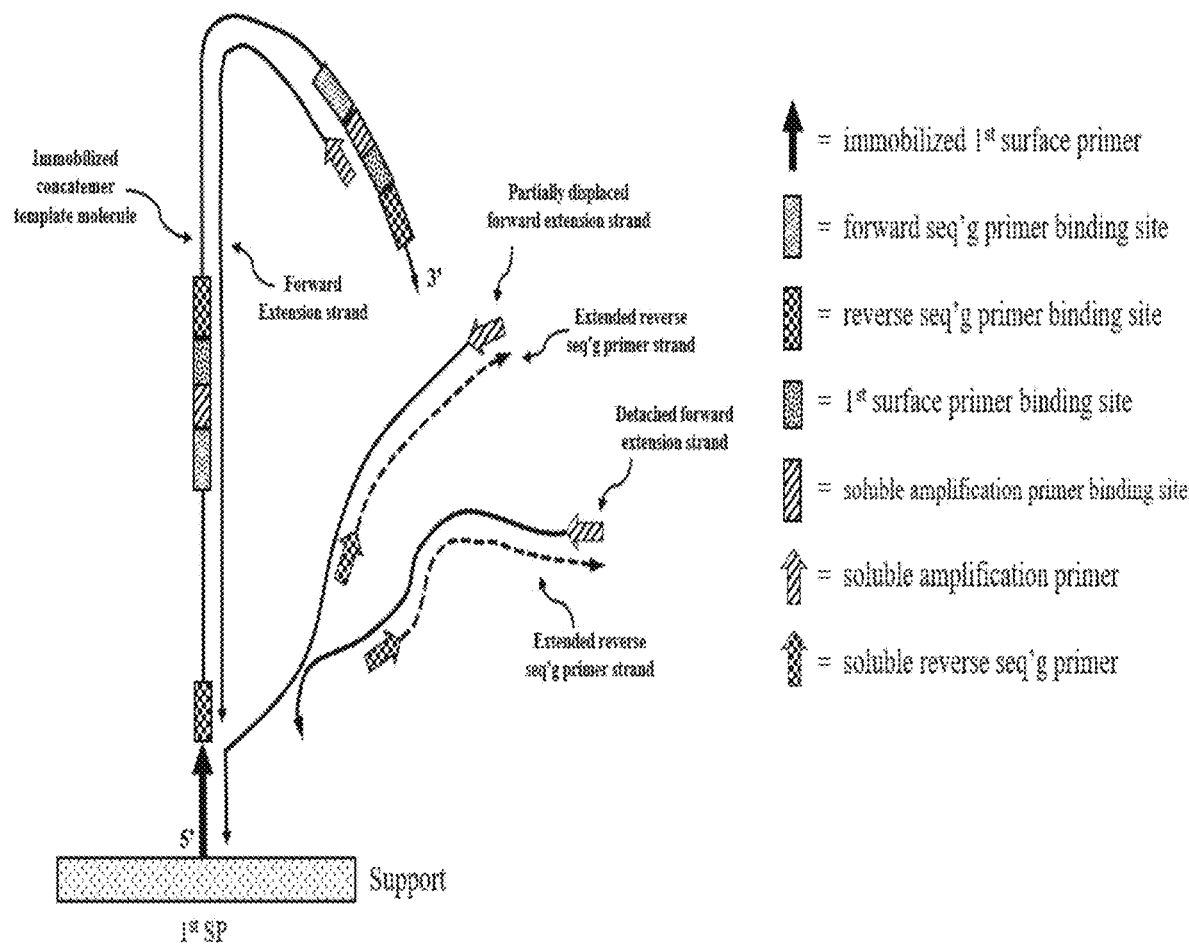

FIG. 78 is a schematic showing an exemplary reverse sequencing reaction conducted on the hybridization complex shown in FIG. 77. The reverse sequencing reaction can be conducted with a plurality of soluble reverse sequencing primers on the partially displaced forward extension strand and the immobilized detached forward extension strand. The reverse sequencing reaction generates extended reverse sequencing primer strands. For the sake of simplicity, FIG. 78 shows one copy of an extended reverse sequencing primer strand on the partially displaced forward extension strand, and one copy of an extended reverse sequencing primer strand on the immobilized detached forward extension strand. The skilled artisan will appreciate that the partially displaced forward extension strand and the immobilized detached forward extension strand can include two or more extended reverse sequencing primer strands hybridized thereon.

Figure 79:
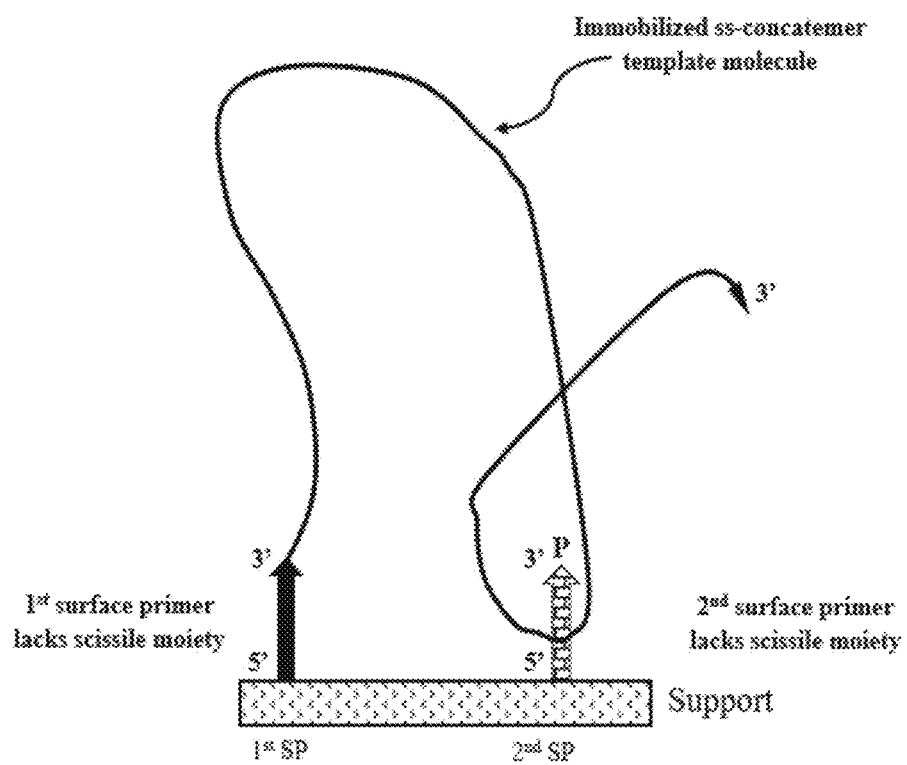

FIG. 79 is a schematic showing an exemplary support having a first and second surface primers immobilized thereon. A portion of the immobilized concatemer template molecule shown in FIG. 73 is hybridized to the immobilized second surface primer. The immobilized concatemer template molecule has two or more copies of a universal binding sequence for an immobilized second surface primer. The portion of the immobilized concatemer template molecule that includes the universal binding sequence for an immobilized second surface primer can hybridize to the immobilized second surface primer.

Figure 80:
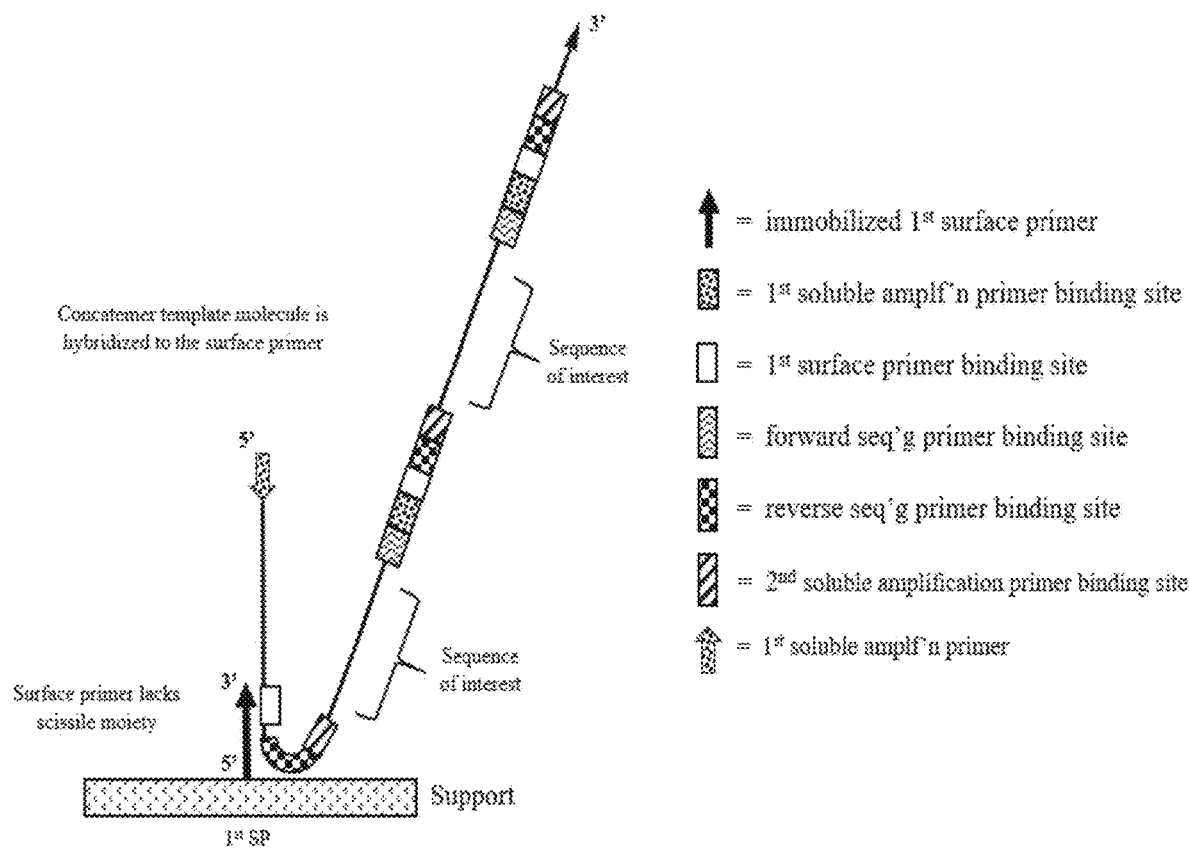

FIG. 80 is a schematic showing an exemplary single stranded nucleic acid concatemer template molecule immobilized to an immobilized first surface primer. In some embodiments, the immobilized concatemer template molecule can be generated by conducting an in-solution rolling circle amplification reaction and distributing the rolling circle amplification reaction onto the support. The arrangement of the various primer binding sequences is for illustration purposes. The skilled artisan will appreciate that many other arrangements are possible. FIGS. 80-86 show the workflow of pairwise sequencing the immobilized concatemer template molecule depicted in FIG. 80.

Figure 81:
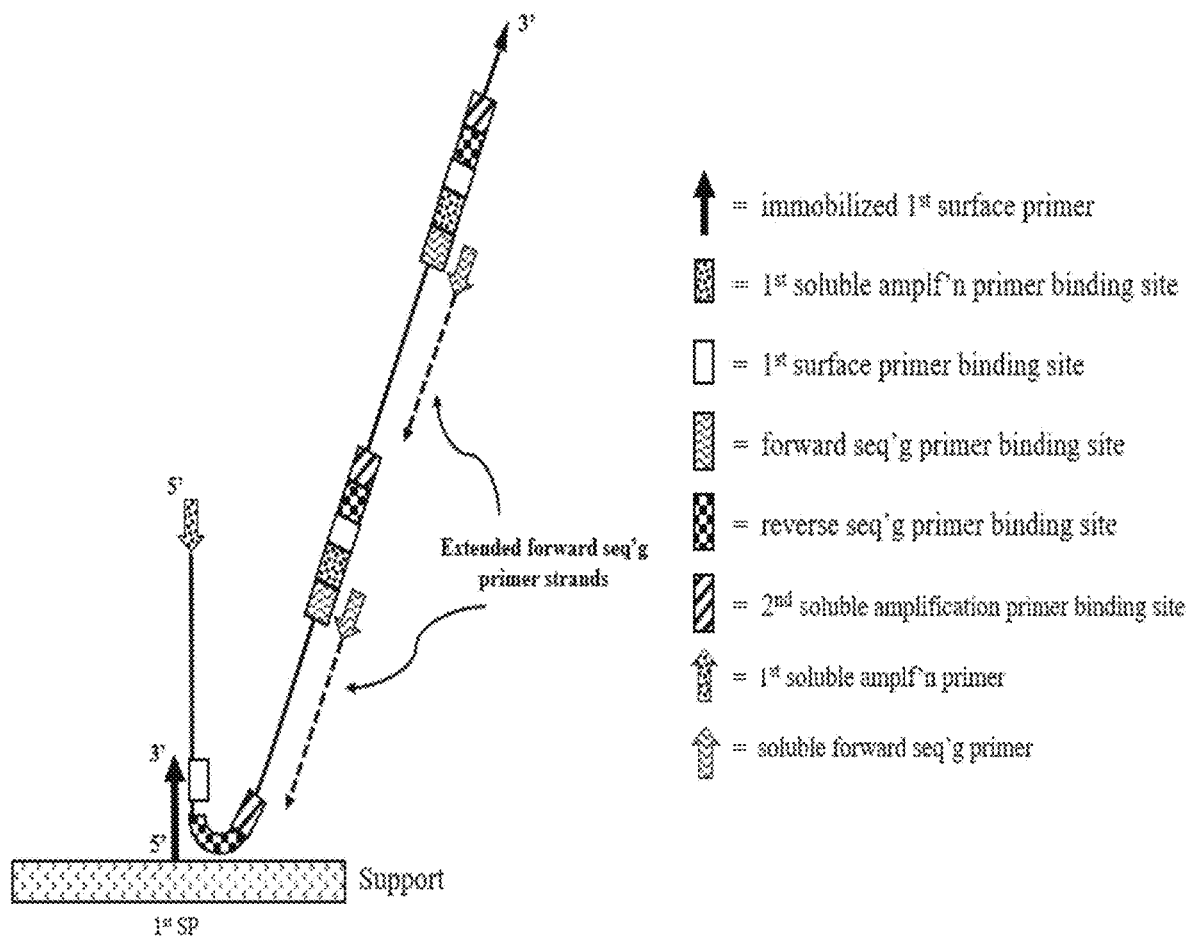

FIG. 81 is a schematic showing an exemplary forward sequencing reaction conducted on the immobilized concatemer template molecule shown in FIG. 80. The forward sequencing reaction can be conducted with a plurality of soluble forward sequencing primers.

The immobilized concatemer template molecule can have two or more extended forward sequencing primer strands hybridized thereon.

Figure 82:
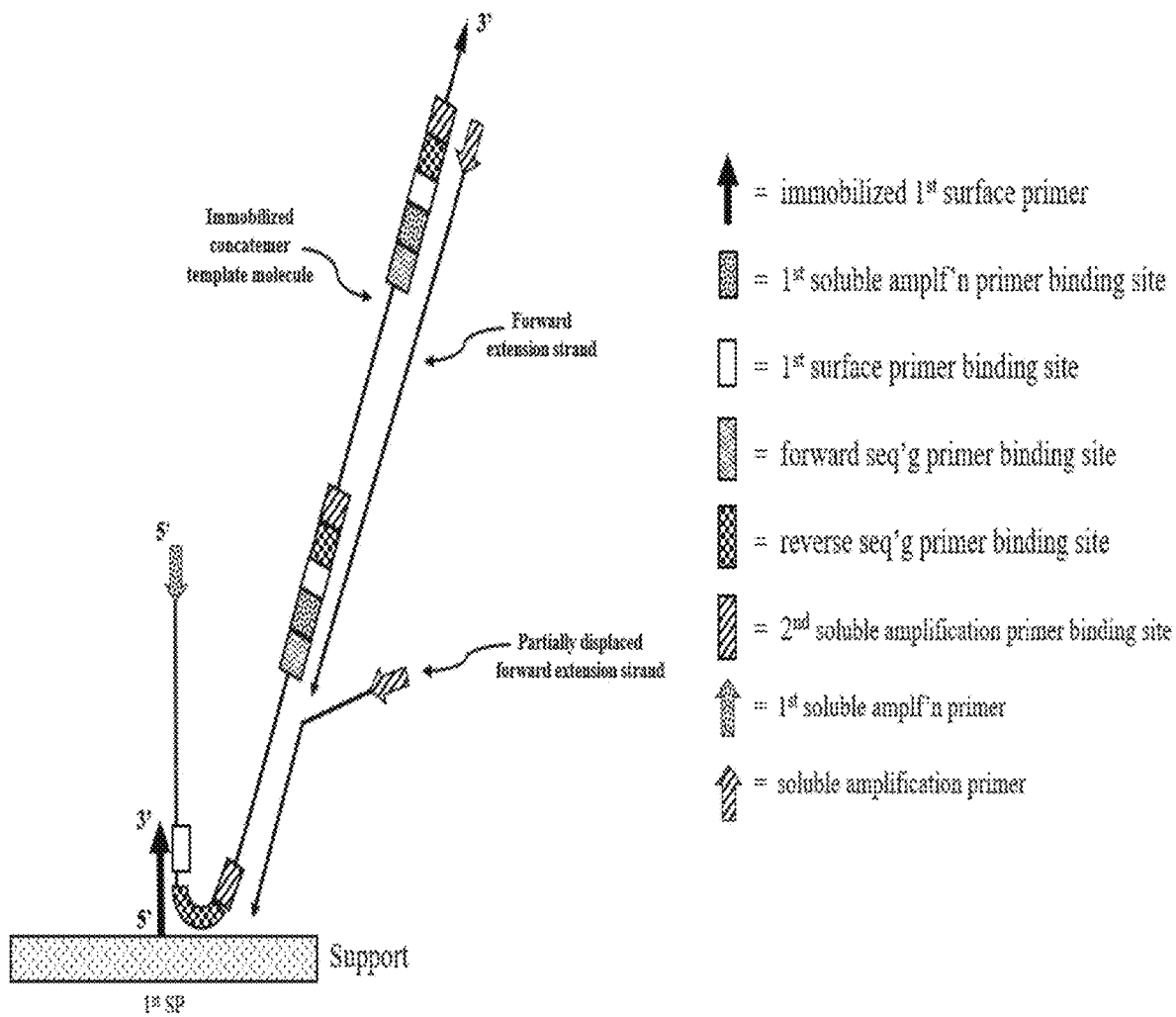

FIG. 82 is a schematic showing an exemplary method for replacing the extended forward sequencing primer strands by conducting a primer extension reaction with soluble amplification primers and strand displacing polymerases in the presence of compaction oligonucleotides, thereby generating a forward extension strand and a partially displaced forward extension strand which are hybridized to the immobilized concatemer template molecule thereby forming an immobilized amplicon.

Figure 83:
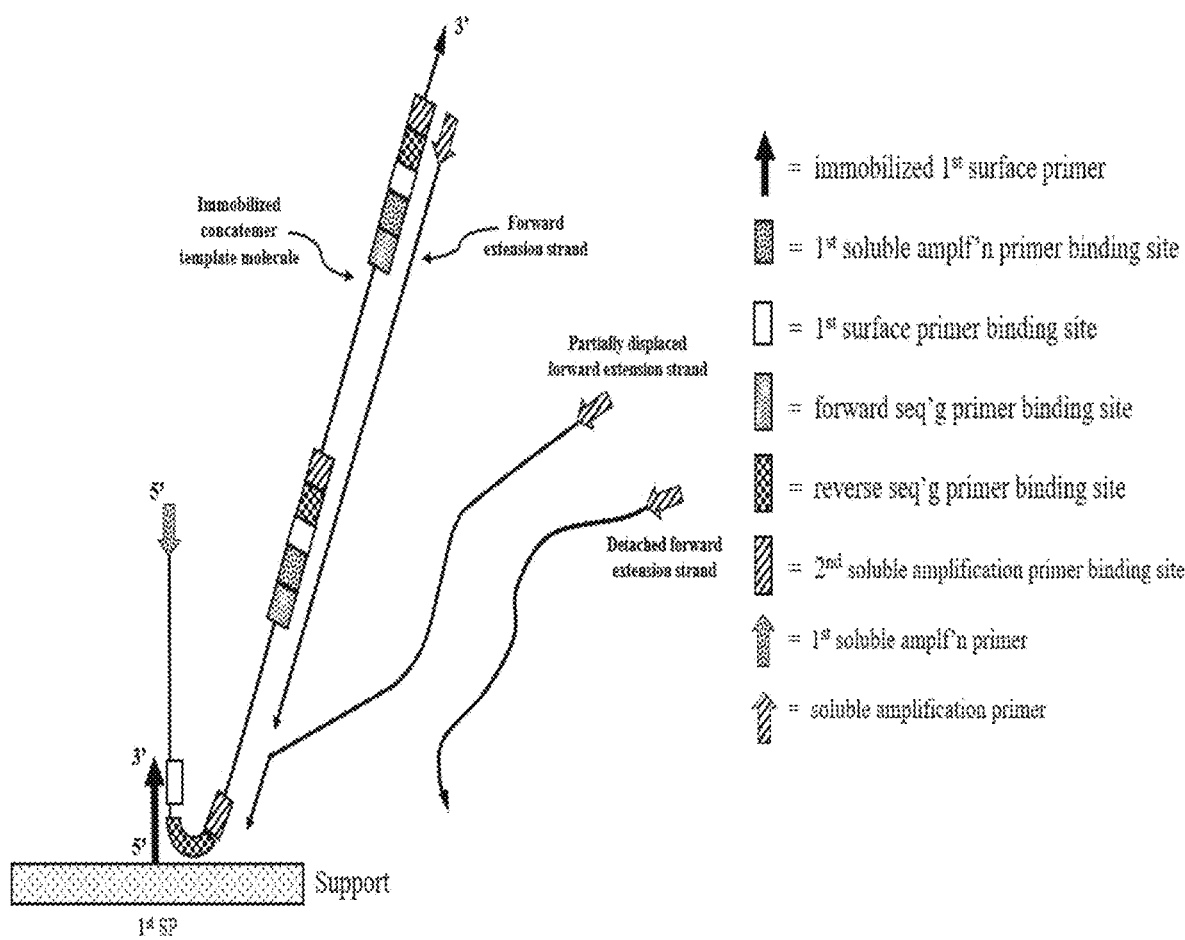

FIG. 83 is a schematic showing a continuation of the exemplary strand displacing method shown in FIG. 82, where the polymerase-catalyzed strand displacing reaction generates a forward extension strand and a partially displaced forward extension strand which are hybridized to the immobilized concatemer template molecule, and a detached forward extension strand which is not hybridized to the immobilized concatemer template molecule.

Figure 84:
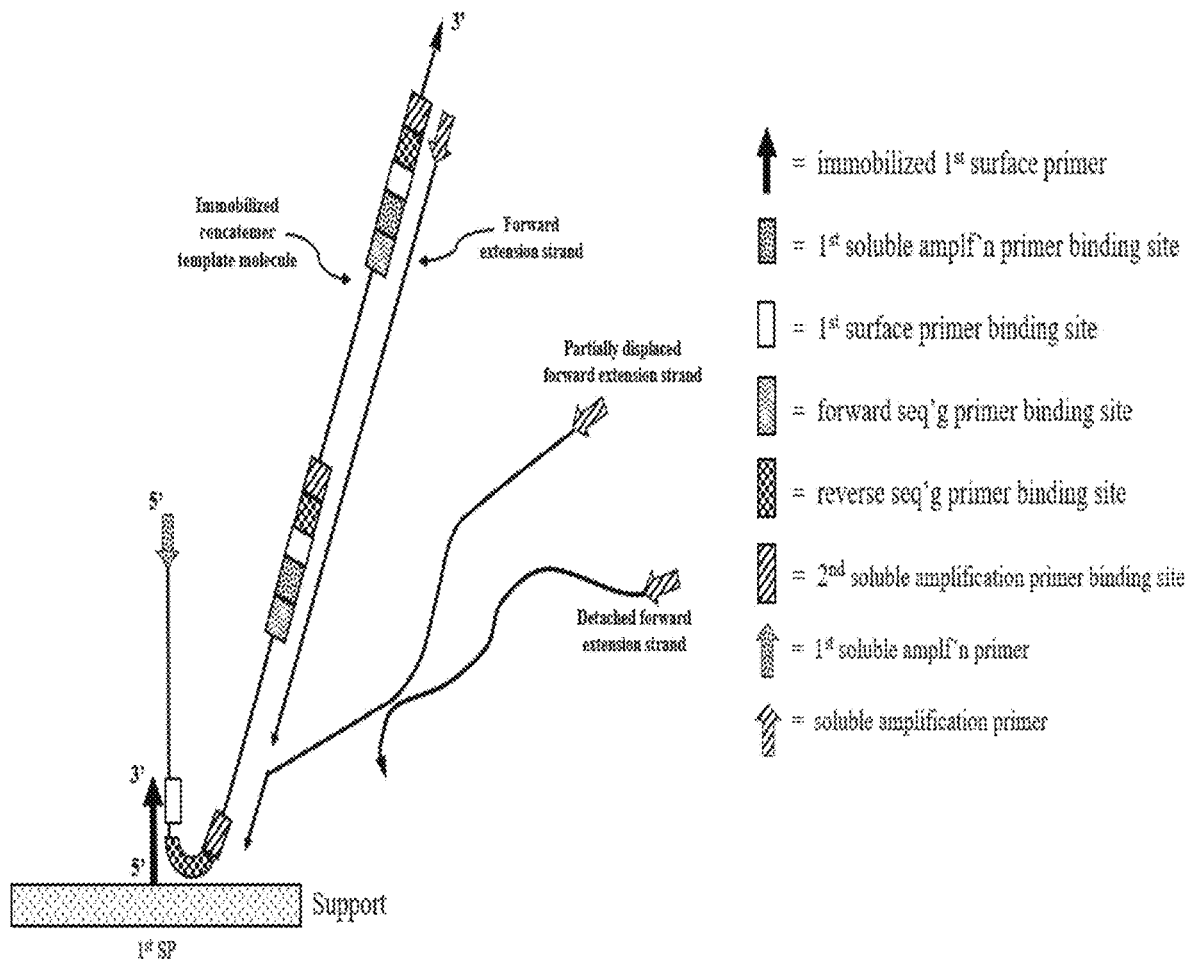

FIG. 84 is a schematic showing an exemplary hybridization complex comprising a forward extension strand and a partially displaced forward extension strand which are hybridized to the immobilized concatemer template molecule, and an immobilized detached forward extension strand which is hybridized to the partially displaced forward extension strand.

Figure 85:
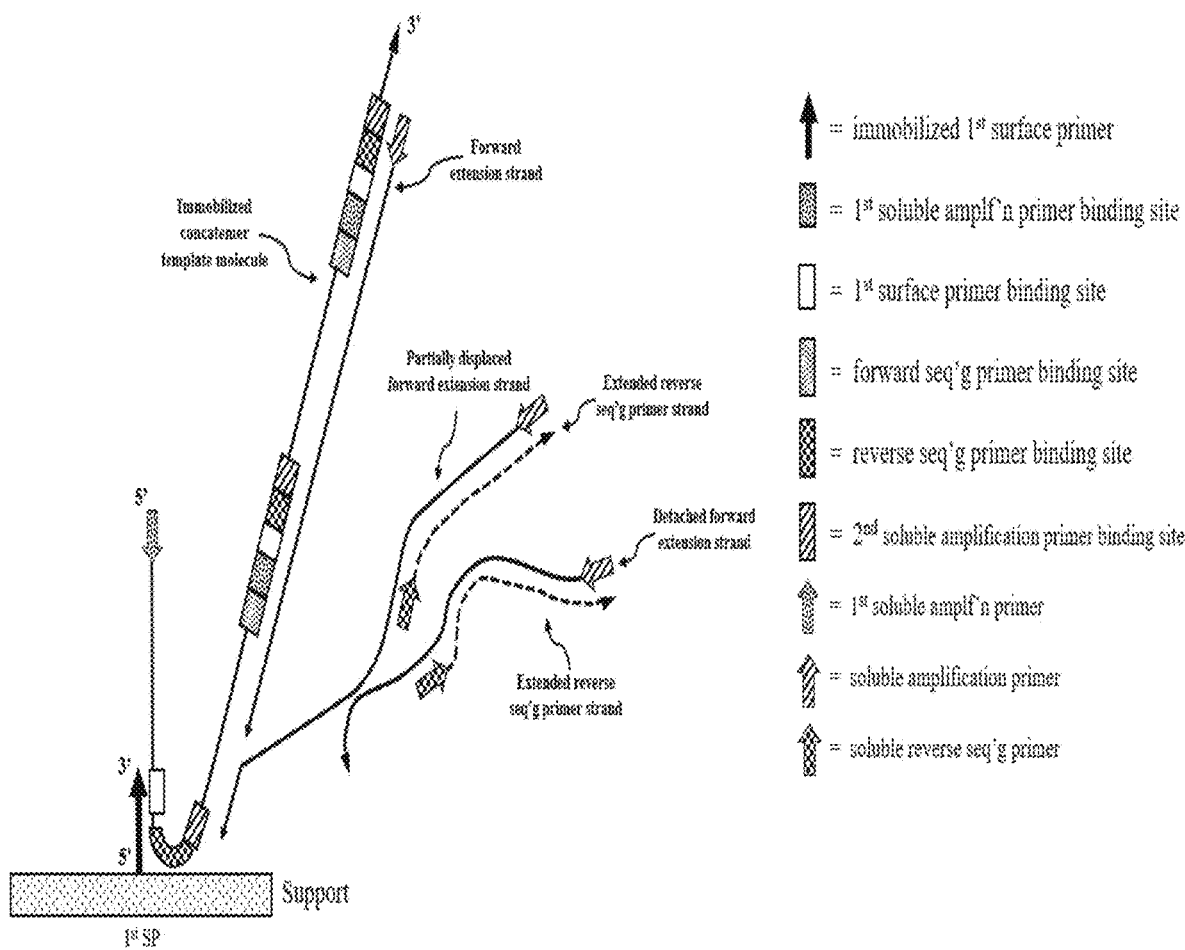

FIG. 85 is a schematic showing an exemplary reverse sequencing reaction conducted on the hybridization complex shown in FIG. 84. The reverse sequencing reaction can be conducted with a plurality of soluble reverse sequencing primers on the partially displaced forward extension strand and the immobilized detached forward extension strand. The reverse sequencing reaction generates extended reverse sequencing primer strands. For the sake of simplicity, FIG. 85 shows one copy of an extended reverse sequencing primer strand on the partially displaced forward extension strand, and one copy of an extended reverse sequencing primer strand on the immobilized detached forward extension strand. The skilled artisan will appreciate that the partially displaced forward extension strand and the immobilized detached forward extension strand can include two or more extended reverse sequencing primer strands hybridized thereon.

Figure 86:
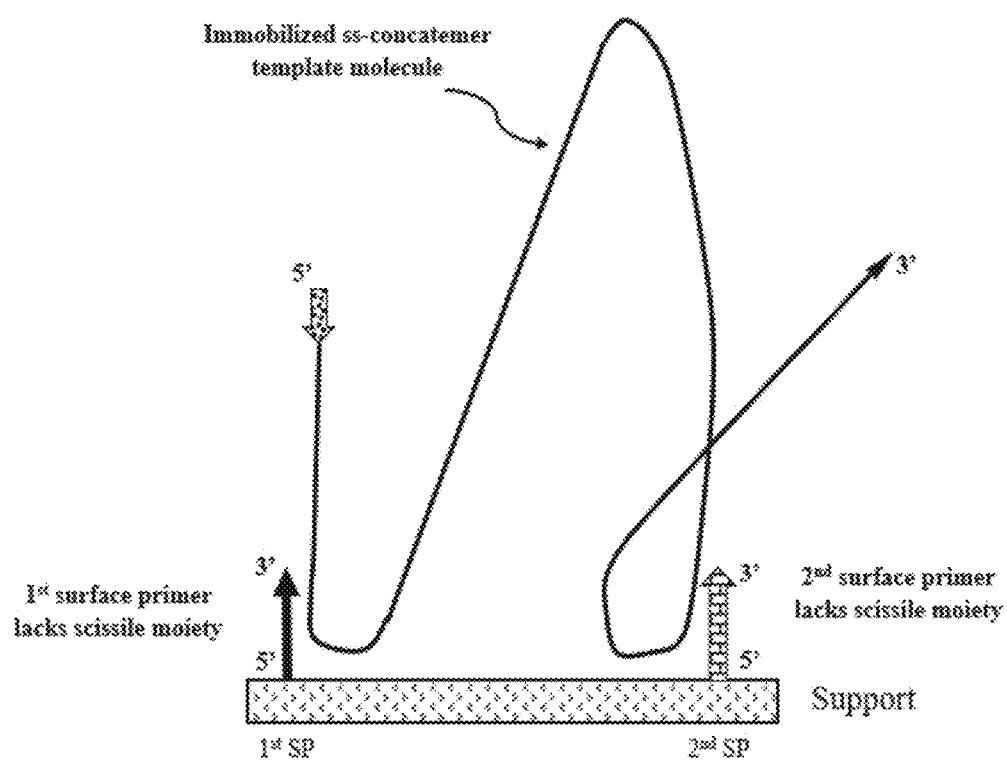

FIG. 86 is a schematic showing an exemplary support having a first and second surface primers immobilized thereon. A portion of the immobilized concatemer template molecule shown in FIG. 80 is hybridized to the immobilized second surface primer. The immobilized concatemer template molecule has two or more copies of a universal binding sequence for an immobilized second surface primer. The portion of the immobilized concatemer template molecule that includes the universal binding sequence for an immobilized second surface primer can hybridize to the immobilized second surface primer.

Figure 87:
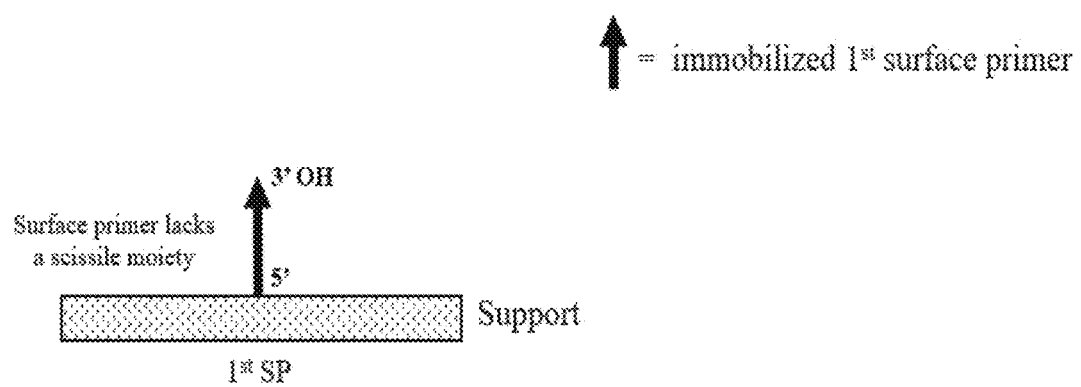

FIG. 87 is a schematic showing an exemplary support having a first surface primer immobilized thereon, which in some embodiments, can be used to conduct an on-support pairwise sequencing workflow.

Figure 88:
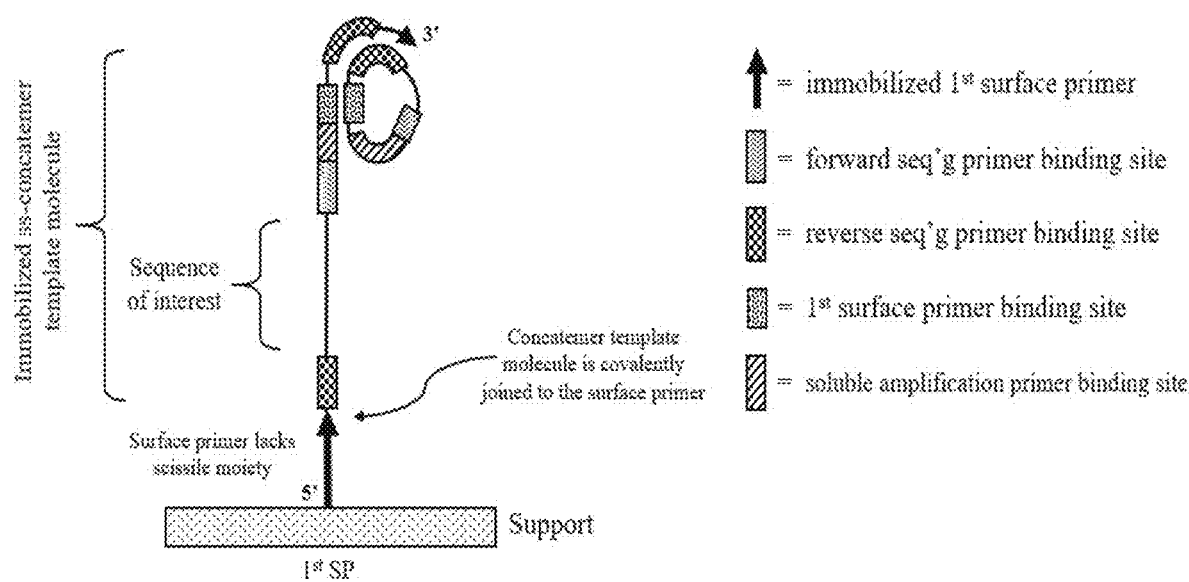

FIG. 88 is a schematic showing an exemplary on-support rolling circle amplification reaction using a nucleic acid circular library molecule, the immobilized first surface primer shown in FIG. 87. The rolling circle amplification reaction generates an immobilized single stranded nucleic acid concatemer template molecule. The arrangement of the various primer binding sequences in the nucleic acid circular library molecule is for illustration purposes. The skilled artisan will appreciate that many other arrangements are possible. FIGS. 87-94 show the workflow of pairwise sequencing the immobilized concatemer template molecule depicted in FIG. 87.

Figure 89:
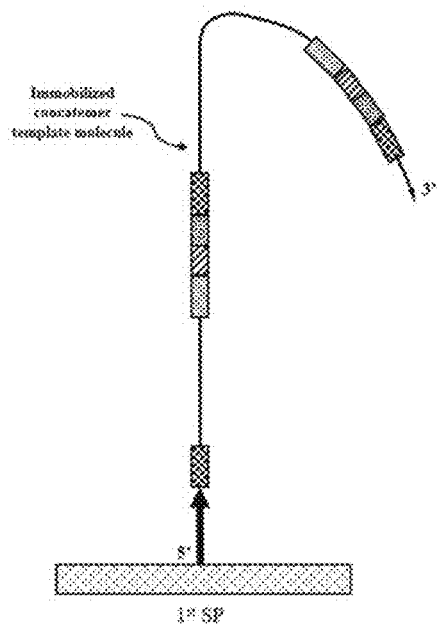

FIG. 89 is a schematic showing an exemplary single stranded nucleic acid concatemer template molecule immobilized to an immobilized first surface primer.

Figure 90:
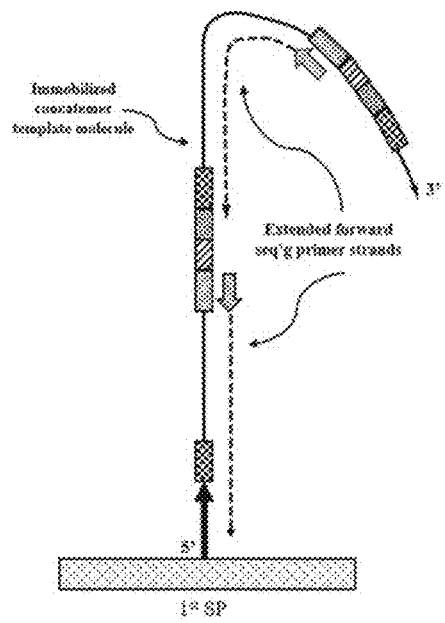

FIG. 90 is a schematic showing an exemplary forward sequencing reaction conducted on the immobilized concatemer template molecule shown in FIG. 89. The forward sequencing reaction can be conducted with a plurality of soluble forward sequencing primers and generates a plurality of extended forward sequencing primer strands. The immobilized concatemer template molecule can have two or more extended forward sequencing primer strands hybridized thereon.

Figure 91:
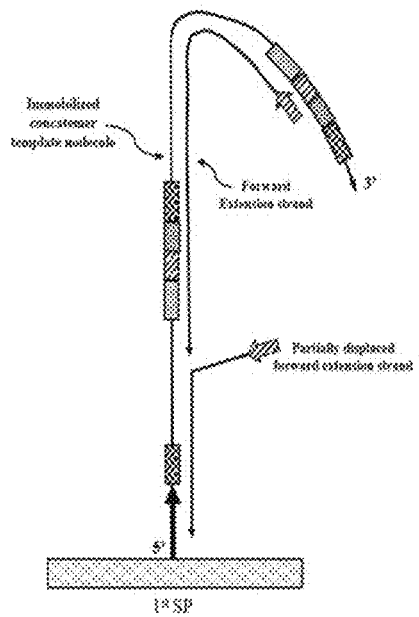

FIG. 91 is a schematic showing an exemplary method for replacing the extended forward sequencing primer strands by conducting a primer extension reaction with soluble amplification primers and strand displacing polymerases in the presence of compaction oligonucleotides, thereby generating a forward extension strand and a partially displaced forward extension strand which are hybridized to the immobilized concatemer template molecule thereby forming an immobilized amplicon.

Figure 92:
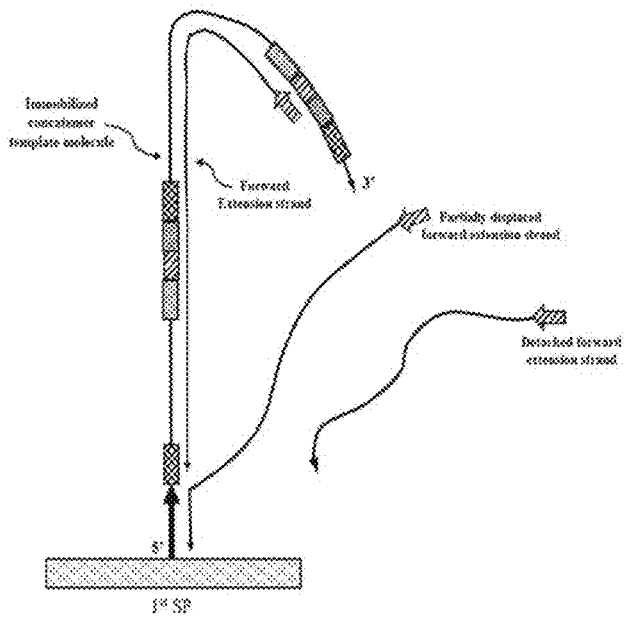

FIG. 92 is a schematic showing a continuation of the exemplary strand displacing method shown in FIG. 91, where the polymerase-catalyzed strand displacing reaction generates a forward extension strand and a partially displaced forward extension strand which are hybridized to the immobilized concatemer template molecule, and a detached forward extension strand which is not hybridized to the immobilized concatemer template molecule.

Figure 93:
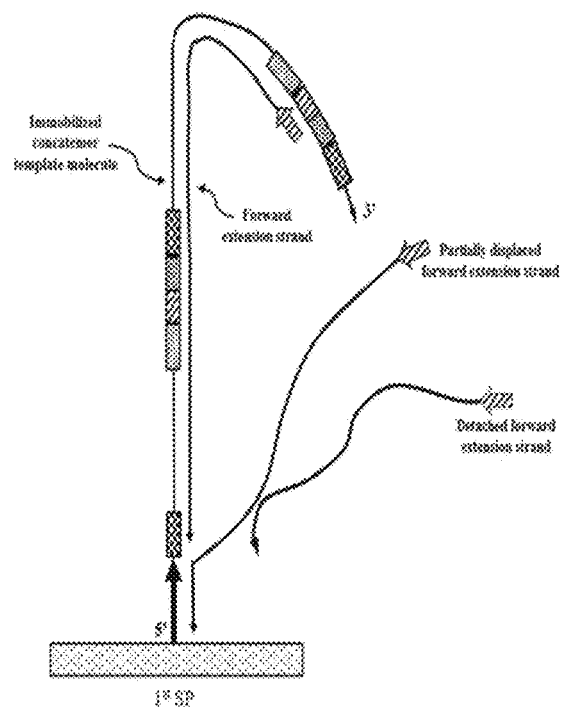

FIG. 93 is a schematic showing an exemplary hybridization complex comprising a forward extension strand and a partially displaced forward extension strand which are hybridized to the immobilized concatemer template molecule, and an immobilized detached forward extension strand which is hybridized to the partially displaced forward extension strand.

Figure 94:
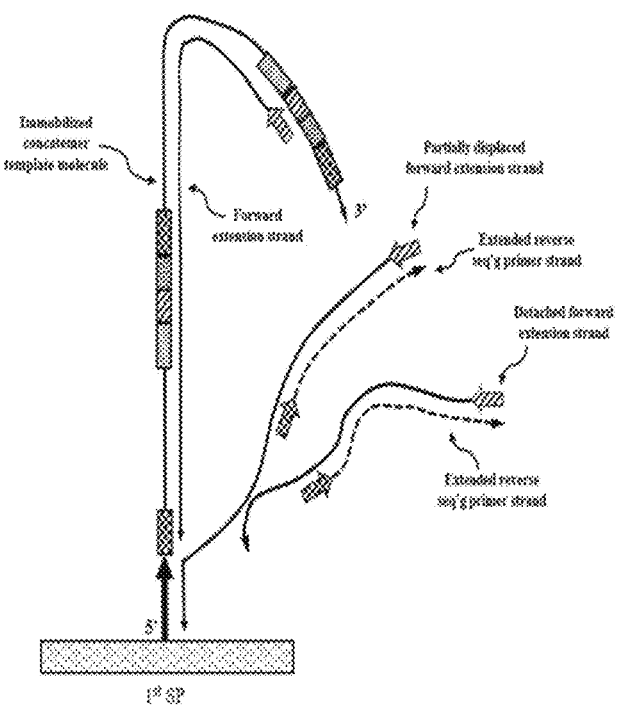

FIG. 94 is a schematic showing an exemplary reverse sequencing reaction conducted on the hybridization complex shown in FIG. 93. The reverse sequencing reaction can be conducted with a plurality of soluble reverse sequencing primers on the partially displaced forward extension strand and the immobilized detached forward extension strand. The reverse sequencing reaction generates extended reverse sequencing primer strands. For the sake of simplicity, FIG. 94 shows one copy of an extended reverse sequencing primer strand on the partially displaced forward extension strand, and one copy of an extended reverse sequencing primer strand on the immobilized detached forward extension strand. The skilled artisan will appreciate that the partially displaced forward extension strand and the immobilized detached forward extension strand can include two or more extended reverse sequencing primer strands hybridized thereon.

Figure 95:
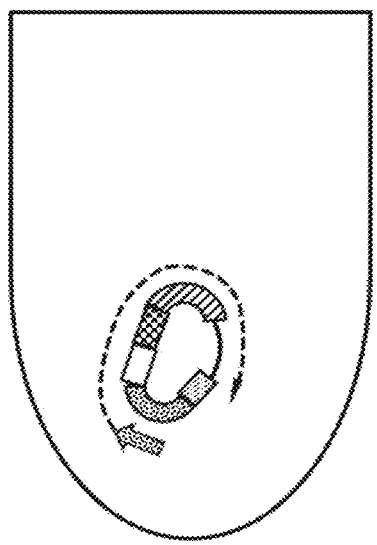

FIG. 95 is a schematic showing an exemplary in-solution rolling circle amplification reaction using a nucleic acid circular library molecule, a soluble first amplification primer, and a mixture of nucleotides. The rolling circle amplification reaction generates in solution single stranded nucleic acid concatemer molecules. The arrangement of the various primer binding sequences in the nucleic acid circular library molecule is for illustration purposes. The skilled artisan will appreciate that many other arrangements are possible. FIGS. 95-103 show the workflow of pairwise sequencing the concatemer molecule depicted in FIG. 96.

Figure 96:
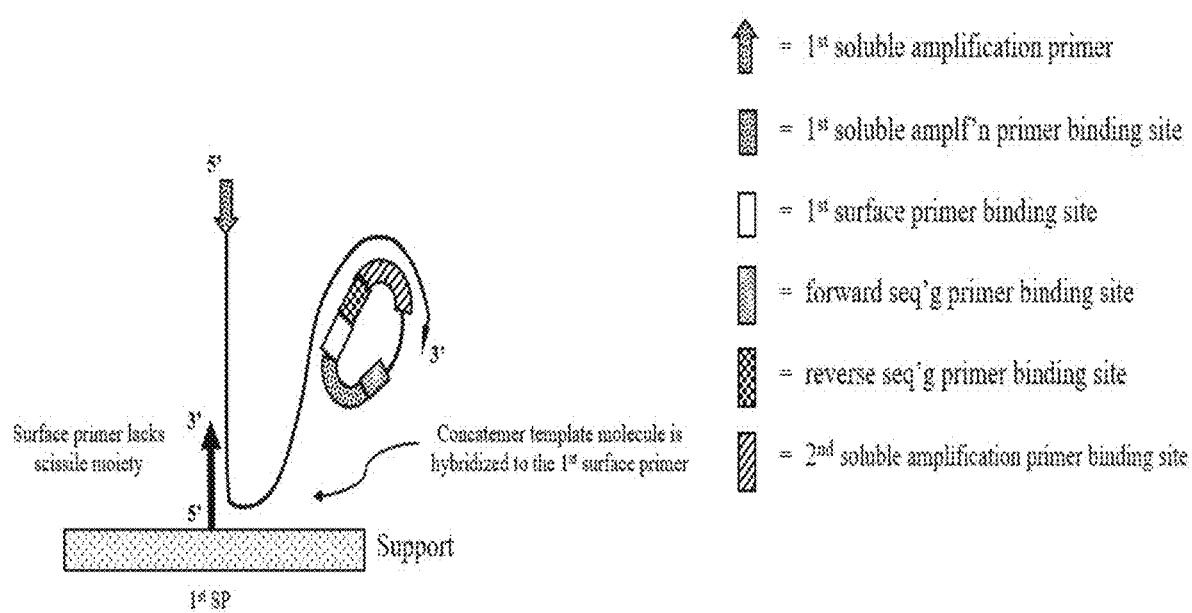

FIG. 96 is a schematic showing an exemplary method comprising distributing the rolling circle amplification reaction depicted in FIG. 95 onto a support having a first surface primer immobilized thereon. The concatemer molecule can hybridize to the immobilized first surface primer.

Figure 97:
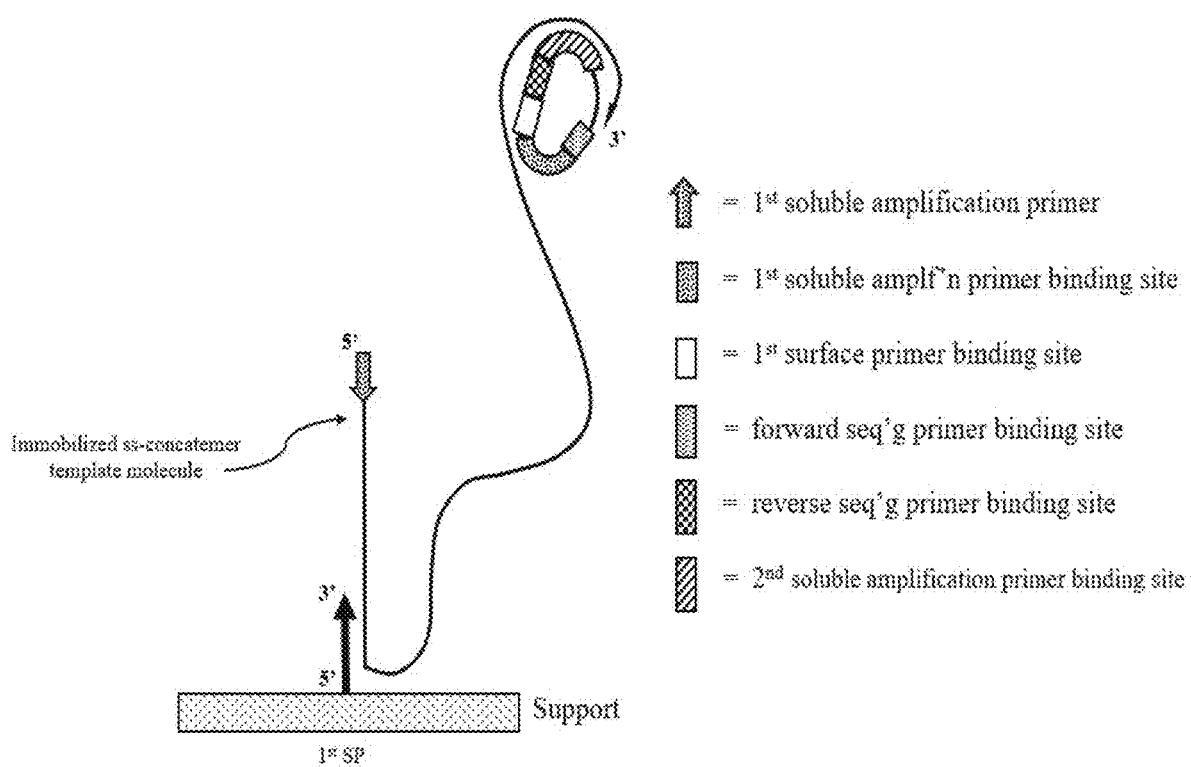

FIG. 97 is a schematic showing an exemplary method which depicts the rolling circle amplification reaction continuing on the support thereby generating an immobilized concatemer template molecule.

Figure 98:
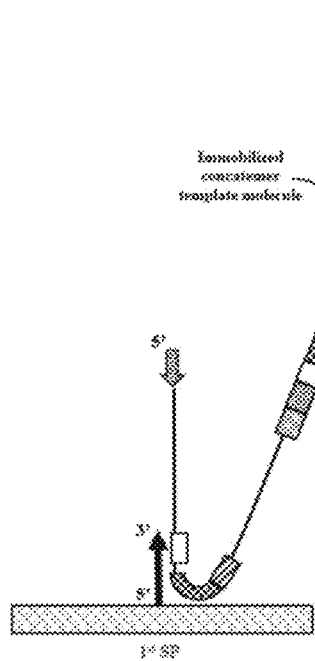

FIG. 98 is a schematic showing an exemplary single stranded nucleic acid concatemer template molecule immobilized to an immobilized first surface primer.

Figure 99:
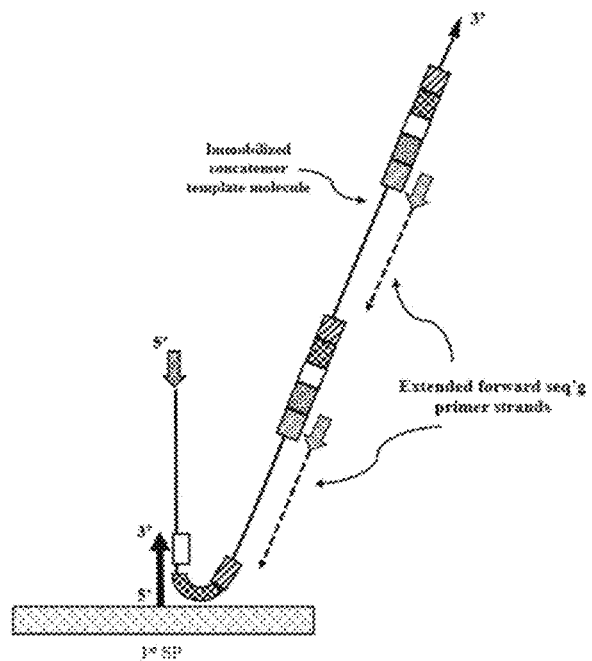

FIG. 99 is a schematic showing an exemplary forward sequencing reaction conducted on the immobilized concatemer template molecule shown in FIG. 98. The forward sequencing reaction can be conducted with a plurality of soluble forward sequencing primers.

The immobilized concatemer template molecule can have two or more extended forward sequencing primer strands hybridized thereon.

Figure 100:
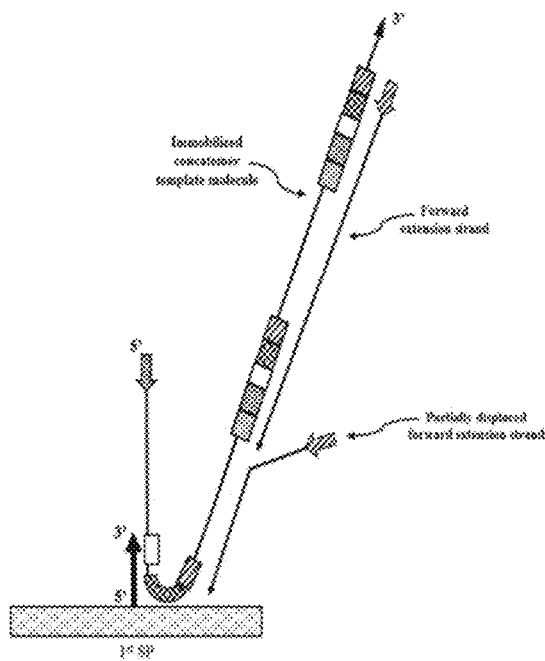

FIG. 100 is a schematic showing an exemplary method for replacing the extended forward sequencing primer strands by conducting a primer extension reaction with soluble amplification primers and strand displacing polymerases in the presence of compaction oligonucleotides, thereby generating a forward extension strand and a partially displaced forward extension strand which are hybridized to the immobilized concatemer template molecule thereby forming an immobilized amplicon.

Figure 101:
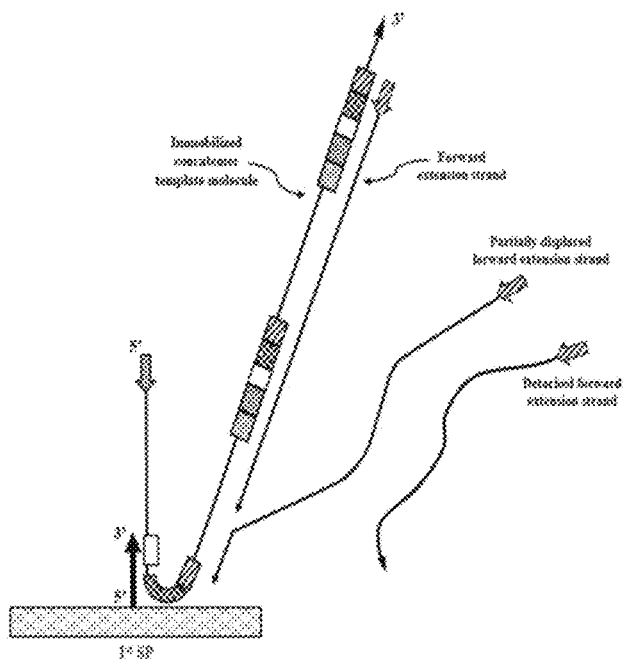

FIG. 101 is a schematic showing a continuation of the exemplary strand displacing method shown in FIG. 100, where the polymerase-catalyzed strand displacing reaction generates a forward extension strand and a partially displaced forward extension strand which are hybridized to the immobilized concatemer template molecule, and a detached forward extension strand which is not hybridized to the immobilized concatemer template molecule.

Figures 102, 103:
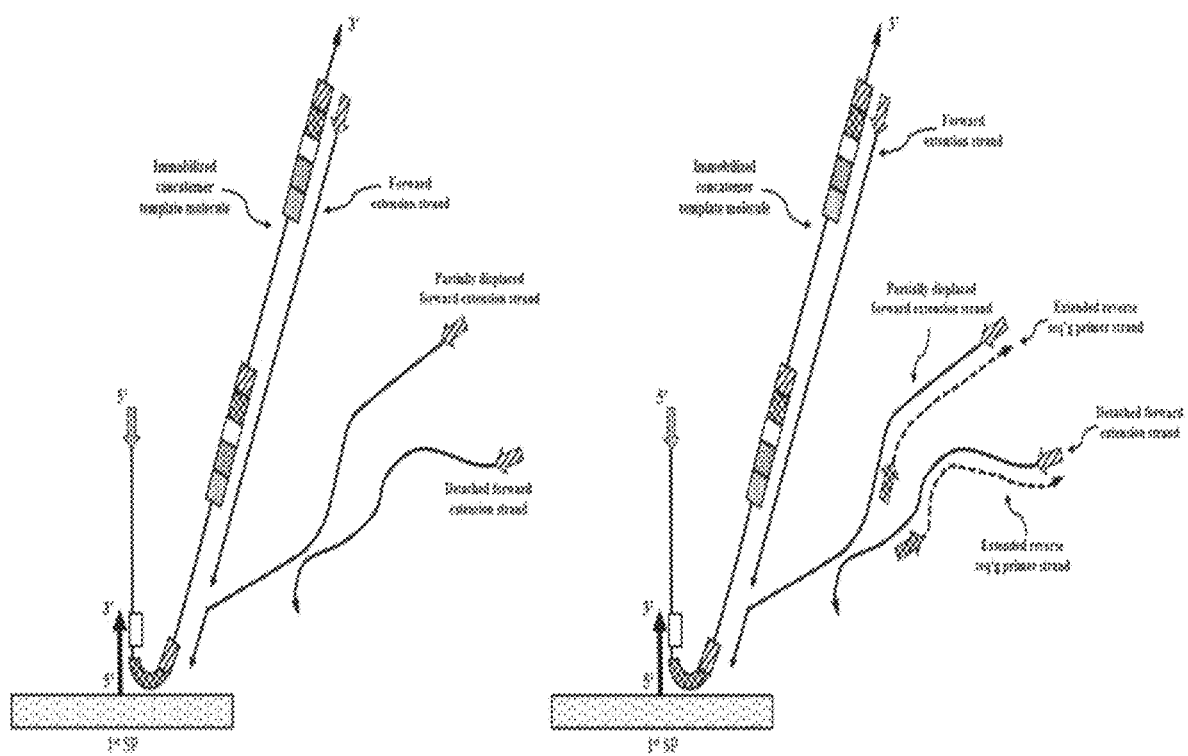

FIG. 102 is a schematic showing an exemplary hybridization complex comprising a forward extension strand and a partially displaced forward extension strand which are hybridized to the immobilized concatemer template molecule, and an immobilized detached forward extension strand which is hybridized to the partially displaced forward extension strand.

FIG. 103 is a schematic showing an exemplary reverse sequencing reaction conducted on the hybridization complex shown in FIG. 102. The reverse sequencing reaction can be conducted with a plurality of soluble reverse sequencing primers on the partially displaced forward extension strand and the immobilized detached forward extension strand. The reverse sequencing reaction generates extended reverse sequencing primer strands. For the sake of simplicity, FIG. 103 shows one copy of an extended reverse sequencing primer strand on the partially displaced forward extension strand, and one copy of an extended reverse sequencing primer strand on the immobilized detached forward extension strand. The skilled artisan will appreciate that the partially displaced forward extension strand and the immobilized detached forward extension strand can include two or more extended reverse sequencing primer strands hybridized thereon.

Figure 104:
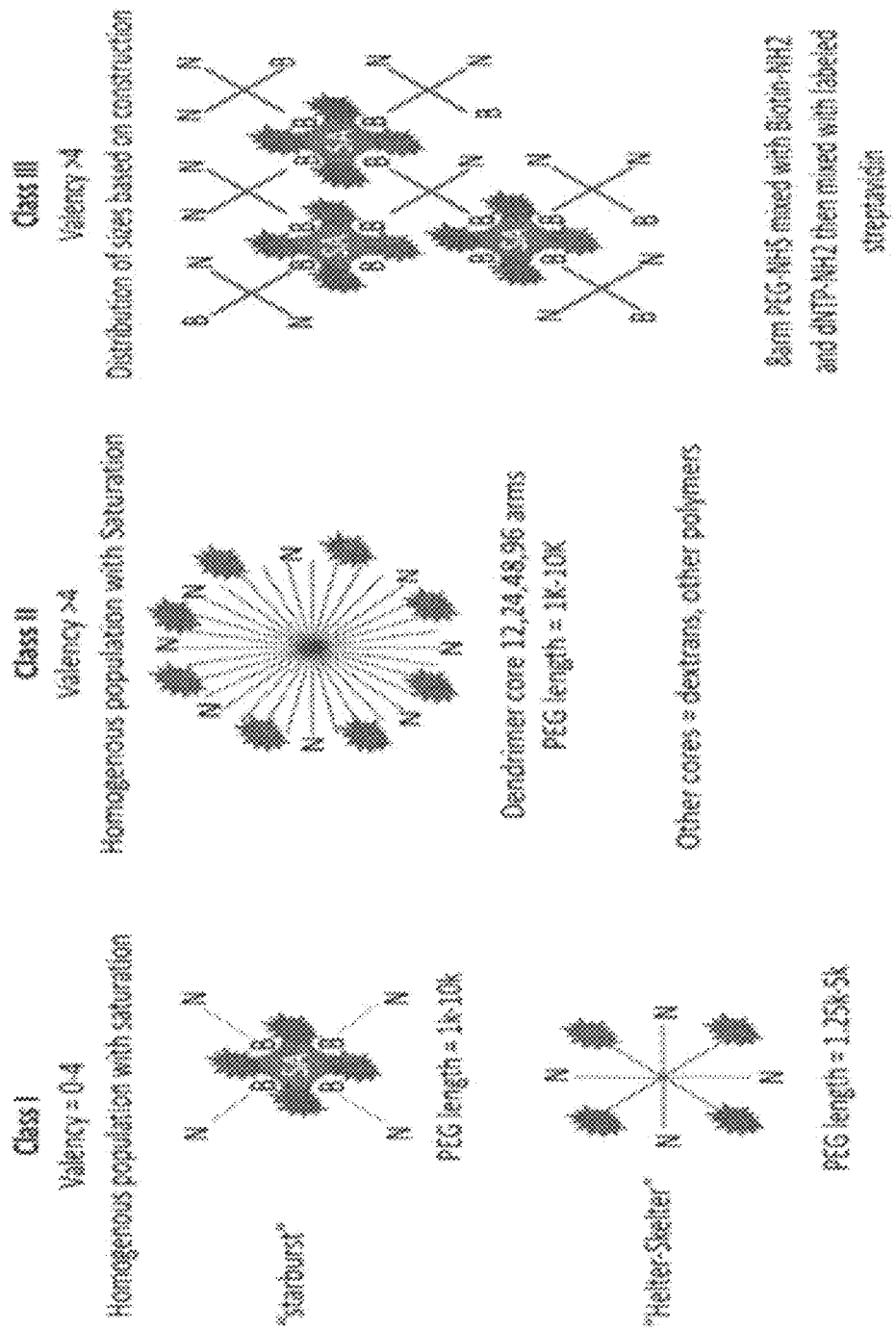

FIG. 104 is a schematic of various exemplary configurations of multivalent molecules. Left: schematics of multivalent molecules having a starburst or helter-skelter configuration. Center: a schematic of a multivalent molecule having a dendrimer configuration. Right: a schematic of multiple multivalent molecules formed by reacting streptavidin with 4-arm or 8-arm PEG-NHS with biotin and dNTPs. Nucleotide units are designated 'N', biotin is designated 'B', and streptavidin is designated 'SA'.

Figure 105:
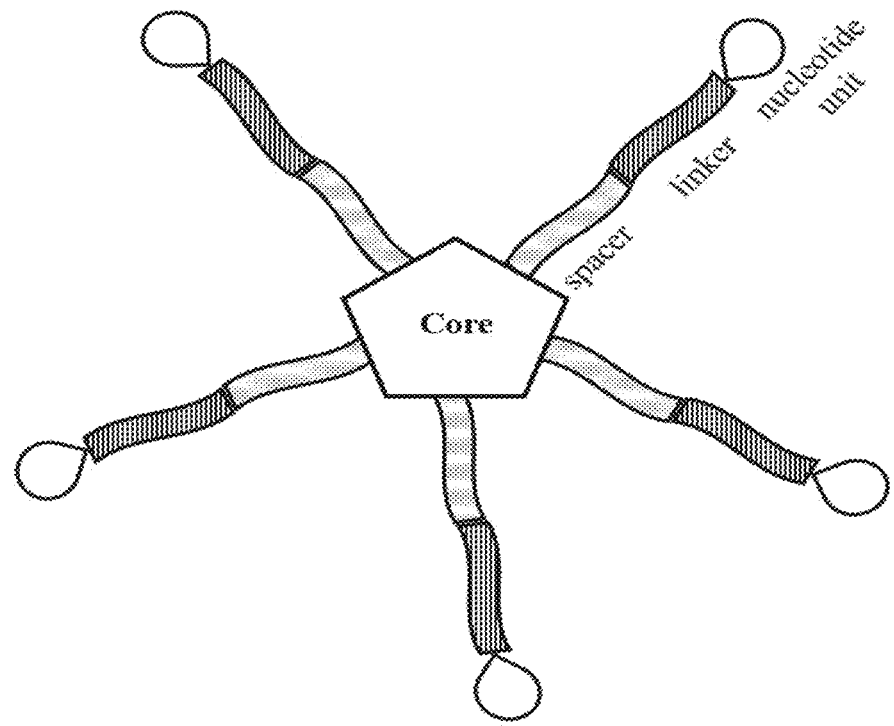

FIG. 105 is a schematic of an exemplary multivalent molecules comprising a generic core attached to a plurality of nucleotide-arms.

Figure 106:
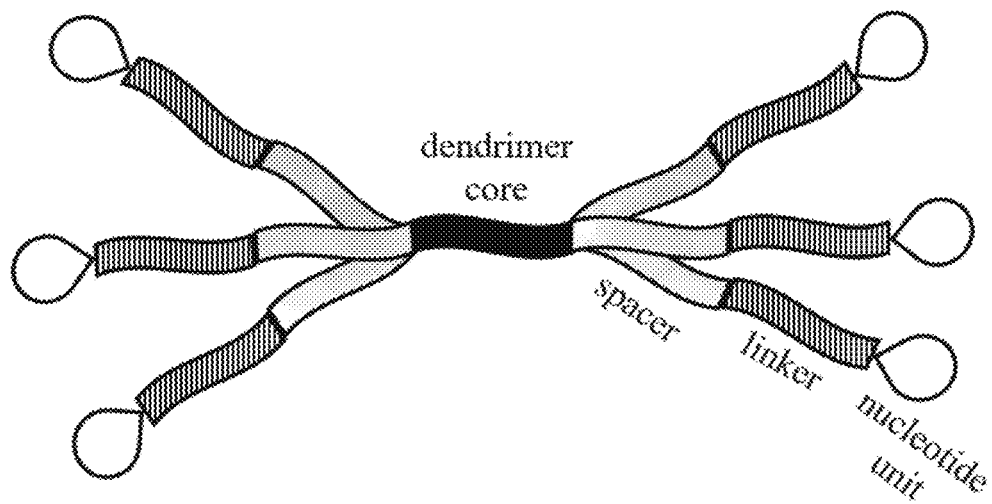

FIG. 106 is a schematic of an exemplary multivalent molecule comprising a dendrimer core attached to a plurality of nucleotide-arms.

Figure 107:
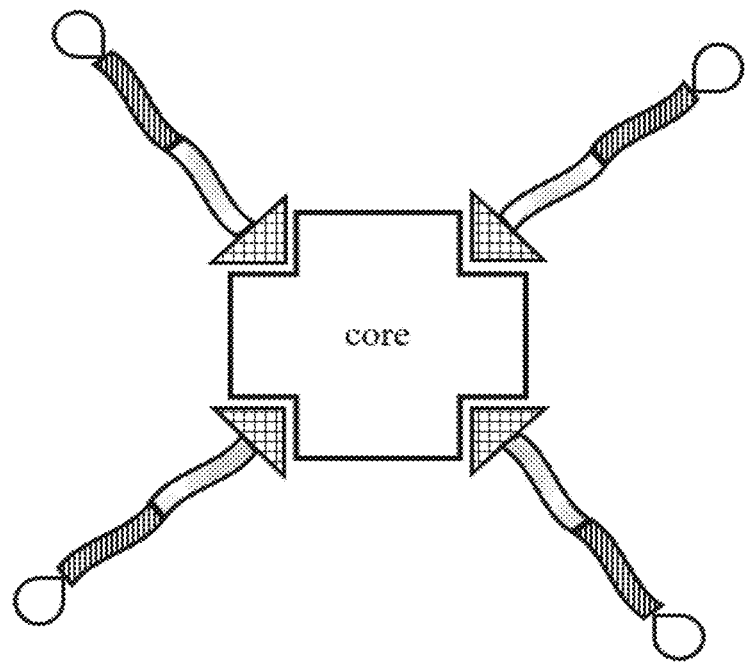

FIG. 107 shows a schematic of an exemplary multivalent molecule comprising a core attached to a plurality of nucleotide-arms, where the nucleotide arms comprise biotin, spacer, linker and a nucleotide unit.

Figure 108:
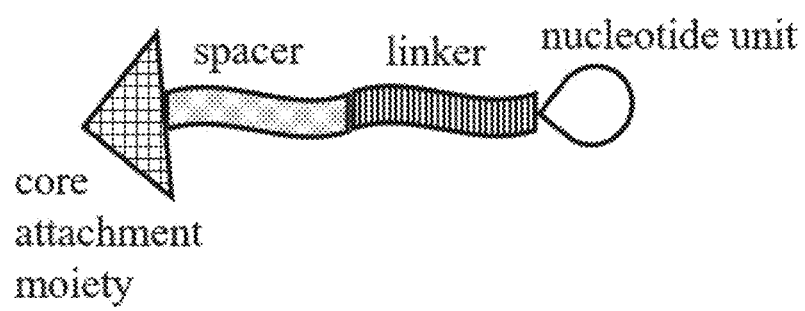

FIG. 108 is a schematic of an exemplary nucleotide-arm comprising a core attachment moiety, spacer, linker and nucleotide unit.

FIG. 109 shows the chemical structure of an exemplary spacer, and the chemical structures of various exemplary linkers, including an 11-atom Linker, 16-atom Linker, 23-atom Linker and an N3 Linker.

FIG. 110 shows the chemical structures of various exemplary linkers, including Linkers 1-9.

FIG. 111 shows the chemical structures of various exemplary linkers joined/attached to nucleotide units.

FIG. 112 shows the chemical structures of various exemplary linkers joined/attached to nucleotide units.

FIG. 113 shows the chemical structures of various exemplary linkers joined/attached to nucleotide units.

Figure 114:
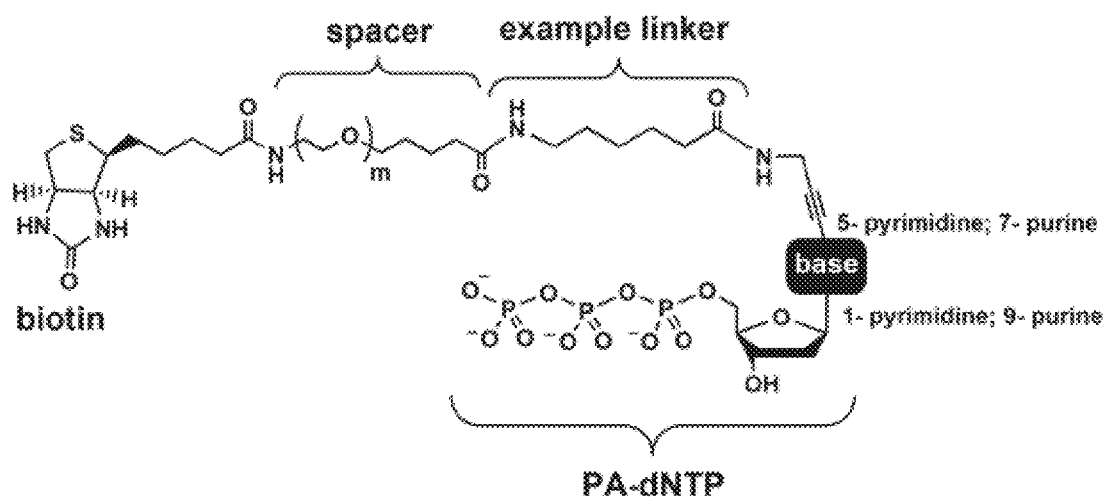

FIG. 114 shows the chemical structure of an exemplary nucleotide-arm. In this example, the nucleotide unit is connected to the linker via a propargyl amine attachment at the 5 position of a pyrimidine base or the 7 position of a purine base. This nucleotide-arm shows an exemplary biotinylated nucleotide-arm.

Figure 115:
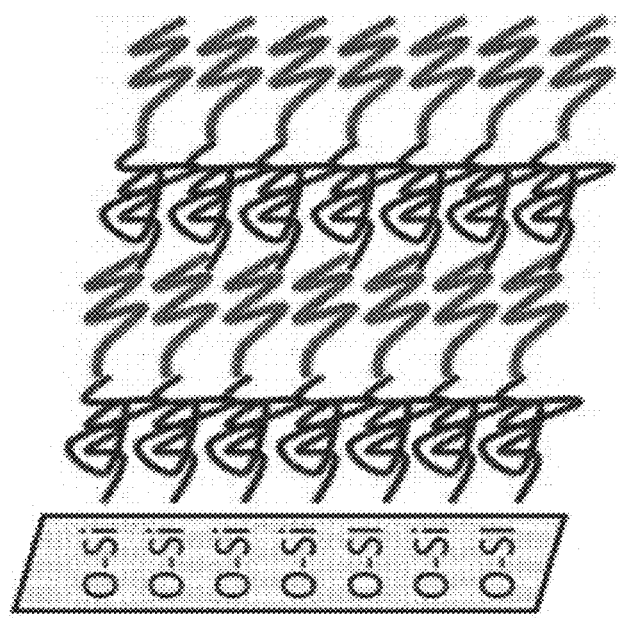

FIG. 115 is an exemplary schematic illustration of one embodiment of the low binding support comprising a glass substrate and alternating layers of hydrophilic coatings which are covalently or non-covalently adhered to the glass, and which further comprises chemically-reactive functional groups that serve as attachment sites for oligonucleotide primers (e g., capture oligonucleotides and circularization oligonucleotides). In an alternative embodiment, the support can be made of any material such as glass, plastic or a polymer material.

Figure 116A:
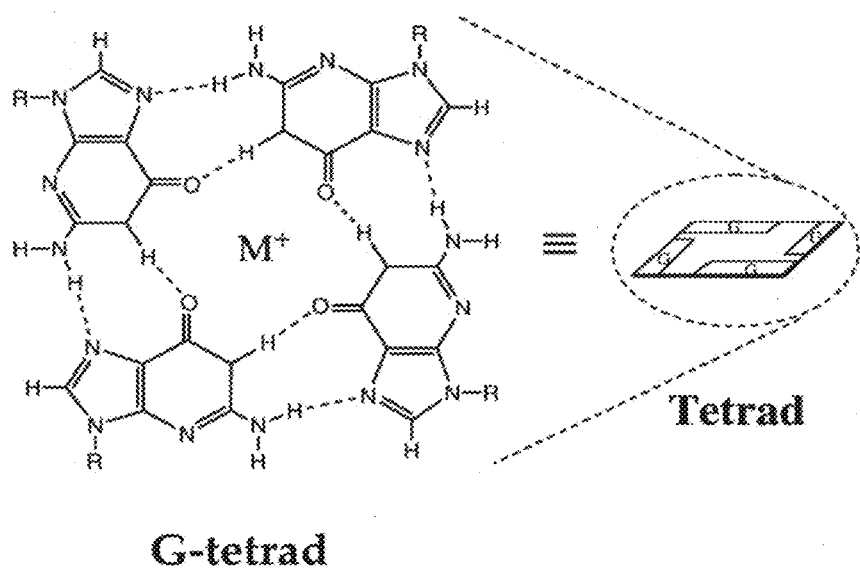

FIG. 116A is a schematic of a guanine tetrad (e.g., G-tetrad).

Figure 116B:
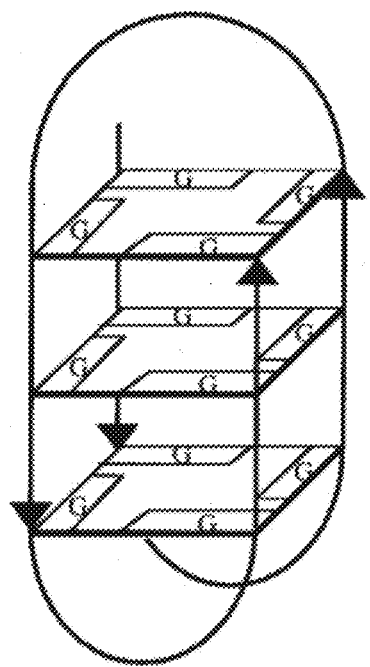

FIG. 116B is a schematic of an intramolecular G-quadruplex structure.

Figure 117:
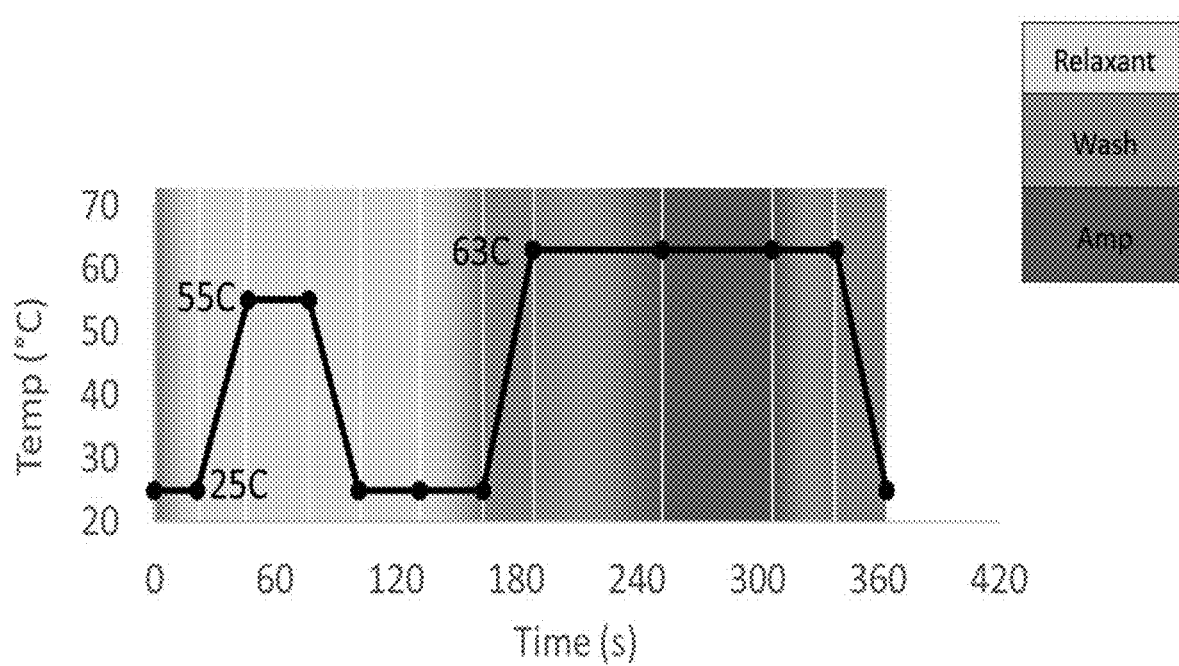

FIG. 117 is a schematic of an exemplary single cycle showing flowing in a nucleic acid relaxing buffer with temperature ramp-up and ramp-down, a washing step, and flowing in a flexing amplification buffer containing a strand-displacing DNA polymerase with temperature ramp-up and MDA incubation and ramp-down. One or more cycles can be conducted of the flowing in a flexing amplification buffer containing a strand-displacing DNA polymerase with temperature ramp-up and MDA amplification and ramp-down.

Figure 118:
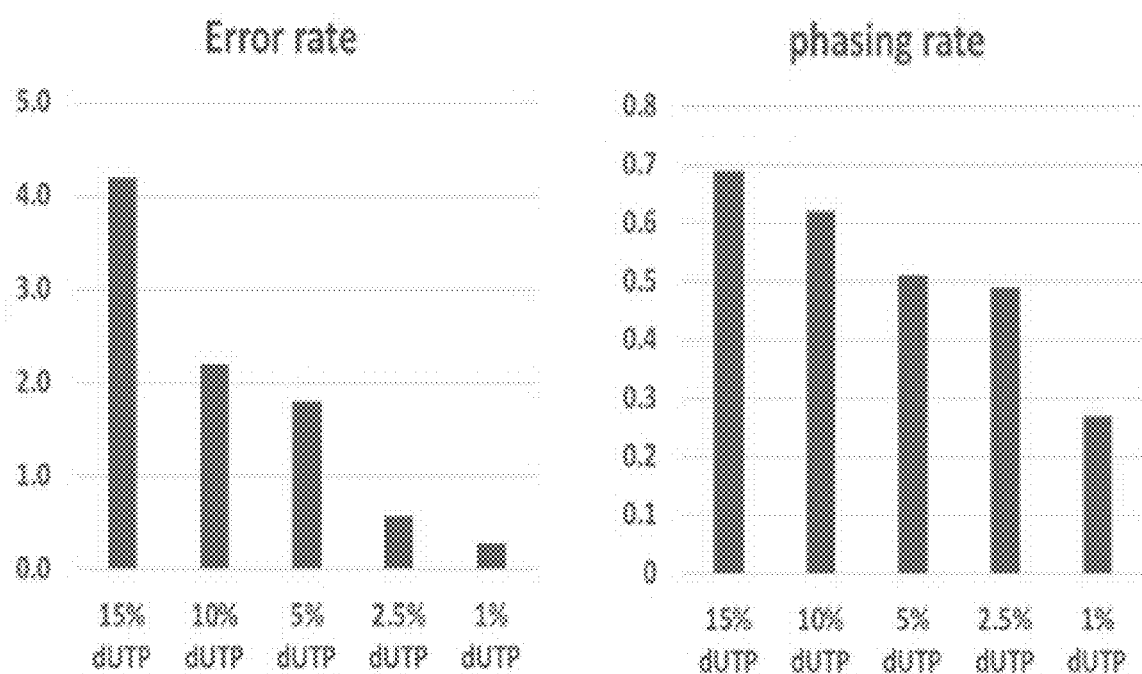

FIG. 118 (left) is a graph showing the error rate from R1 sequencing reads of template molecules having various levels of uracil. FIG. 118 (right) is a graph showing the phasing rate from R1 sequencing reads of template molecules having various levels of uracil. The data shows that sequencing template molecules having lower levels of incorporated uracil yield lower error rates and phasing rates. The level of uracil in the template molecules also affects the intensity ratio of R2/R1 reads.

Figure 119:
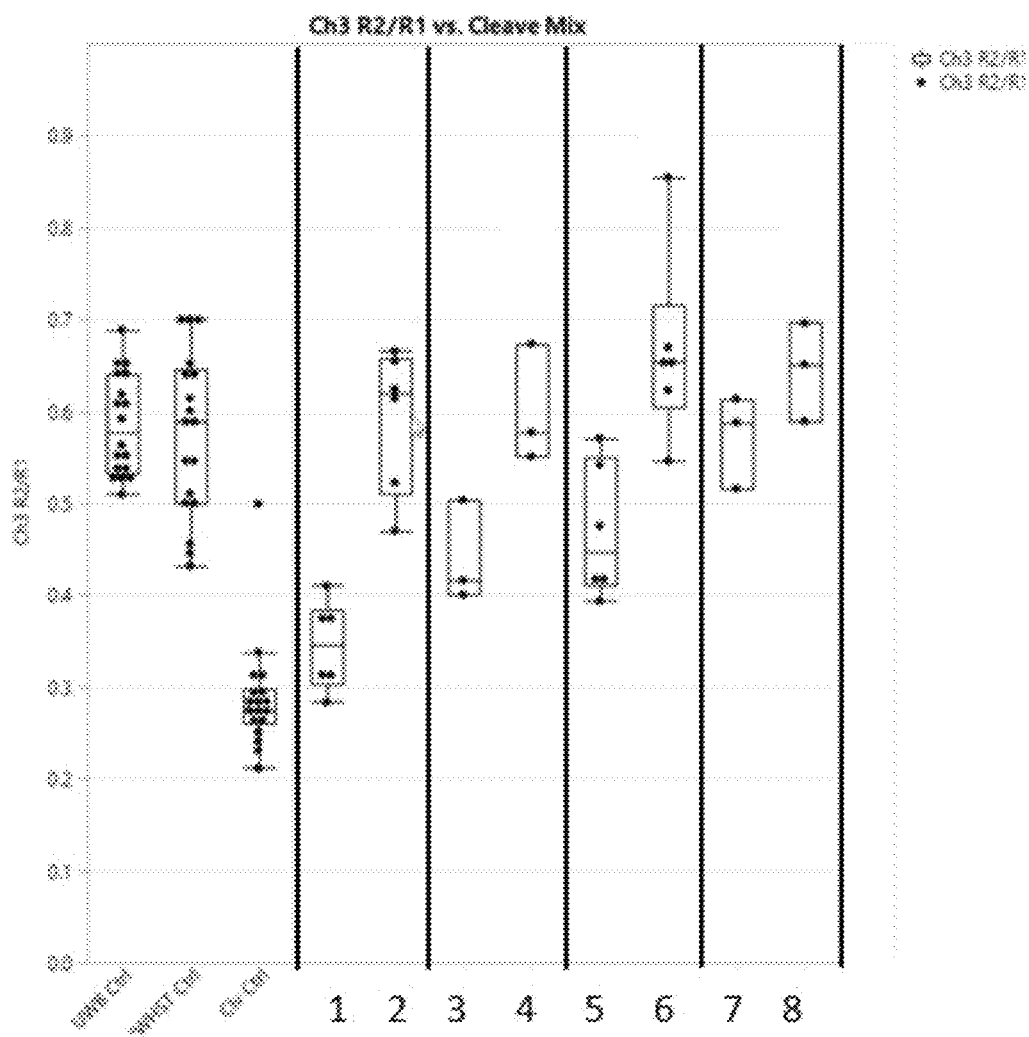

FIG. 119 is a graph showing increased ratio of signal intensity for R2/R1 sequencing reads when the sequencing workflow employs a cleaving reagent that includes a compound that reduces photo-damage to nucleic acids. Lanes 1, 3, 5 and 7 show the R2/R1 signal intensity using different cleaving reagent formulations without a compound that reduces photo-damage. Lanes 2, 4, 6 and 8 show the R2/R1 signal intensity using corresponding cleaving reagent formulations that include a compound that reduces photo-damage.

FIG. 120 is the amino acid sequence of a wild DNA polymerase having a backbone sequence from RLF 89458.1 (SEQ ID NO:1).

FIG. 121 is the amino acid sequence of a wild DNA polymerase having a backbone sequence from RLF 78286.1 (SEQ ID NO:2).

FIG. 122 is the amino acid sequence of a wild DNA polymerase having a backbone sequence from NOZ 58130.1 (SEQ ID NO:1316).

FIG. 123 is the amino acid sequence of a wild type DNA polymerase having a backbone sequence from RMF 90817.1 (SEQ ID NO:2215).

FIG. 124 is the amino acid sequence of a wild type DNA polymerase having a backbone sequence from MBC 7218772.1 (SEQ ID NO:2367).

FIG. 125 is the amino acid sequence of a wild type DNA polymerase having a backbone sequence from WP 175059460.1 (SEQ ID NO:2393).

FIG. 126 is the amino acid sequence of a wild type DNA polymerase having a backbone sequence from KUO 42443.1 (SEQ ID NO:2408).

FIG. 127 is the amino acid sequence of a wild DNA polymerase having a backbone sequence from NOZ 77387.1 (SEQ ID NO:2436).

FIG. 128 is the amino acid sequence of a wild type DNA polymerase having a backbone sequence from *Geobacillus stearothermophilus* (Bst polymerase) (SEQ ID NO:2502).

FIG. 129 is the amino acid sequence of a 9° N polymerase (SEQ ID NO:2503).

FIG. 130 is the amino acid sequence of a 9° N polymerase UniProt Q56366 (SEQ ID NO:2504).

FIG. 131 is the amino acid sequence of THERMINATOR polymerase (SEQ ID NO:2505).

FIG. 132 is the amino acid sequence of a VENT polymerase UniProt P30317 (SEQ ID NO:2506).

FIG. 133 is the amino acid sequence of a DEEP VENT polymerase UniProt Q51334 (SEQ ID NO:2507).

FIG. 134 is the amino acid sequence of a Pfu polymerase UniProt P61875 (SEQ ID NO:2508).

FIG. 135 is the amino acid sequence of a *Pyrococcus abyssi* polymerase UniProt POCL77 (SEQ ID NO:2509).

FIG. 136 is the amino acid sequence of an RB69 polymerase (SEQ ID NO:2510).

FIG. 137 is the amino acid sequence of a Phi29 polymerase (SEQ ID NO:2455).

FIG. 138 (17 sheets) is Table 1 which lists the relative incorporation activity of mutant variants (SEQ ID NOS:3-293) carrying various mutation substitution sites. Table 1 lists the incorporation activity of 3'methylazido nucleotides at the N+1 position of an extending polynucleotide chain at 42° C. The mutant variants are present in cleared lysates from expression strains. The mutation substitution sites are relative to the numbering in SEQ ID NO:1 of wild type DNA polymerase having a backbone sequence of RLF 89458.1.

FIG. 139 (26 sheets) is Table 2 which lists the fluorescent signal intensity of mutant variants (SEQ ID NOS:294-725) carrying various mutation substitution sites. The mutation substitution sites are relative to the numbering in SEQ ID NO:1 of wild type DNA polymerase having a backbone sequence of RLF 89458.1.

FIG. 140 (33 sheets) is Table 3 which lists mutant DNA polymerases having a backbone sequence of RLF 89458.1 and carrying various mutation substitution sites (SEQ ID NOS:726-1315). The mutation substitution sites are relative to the numbering in SEQ ID NO:1 of wild type DNA polymerase having a backbone sequence of RLF 89458.1.

FIG. 141 (7 sheet) is Table 4 which lists the relative incorporation activity of mutant variants (SEQ ID NOS: 1317-1447) carrying various mutation substitution sites. Table 4 lists the incorporation activity of 3'methylazido nucleotides at the N+1 position of an extending polynucleotide chain at 42° C. The mutant variants are present in cleared lysates from expression strains. The mutation substitution sites are relative to the numbering in SEQ ID NO:1316 of wild type DNA polymerase having a backbone sequence of NOZ 58130.1.

FIG. 142 (1 sheet) is Table 5 which lists the fluorescent signal intensity of mutant variants (SEQ ID NOS:1448-1450) carrying various mutation substitution sites. The mutation substitution sites are relative to the numbering in SEQ ID NO:1316 of wild type DNA polymerase having a backbone sequence of NOZ 58130.1.

FIG. 143 (40 sheets) is Table 6 which lists mutant DNA polymerases having a backbone sequence of NOZ 58130.1 and carrying various mutation substitution sites (SEQ ID NOS:1451-2214). The mutation substitution sites are relative to the numbering in SEQ ID NO:1316 of wild type DNA polymerase having a backbone sequence of NOZ 58130.1.

FIG. 144 (1 sheet) is Table 7 which lists the relative incorporation activity of mutant variants (SEQ ID NOS: 2216-2236) carrying various mutation substitution sites. Table 7 lists the incorporation activity of 3'methylazido nucleotides at the N+1 position of an extending polynucleotide chain at 42° C. The mutant variants are present in cleared lysates from expression strains. The mutation substitution sites are relative to the numbering in SEQ ID NO:2215 of wild type DNA polymerase having a backbone sequence of RMF 90817.1.

FIG. 145 (6 sheets) is Table 8 which lists mutant DNA polymerases having a backbone sequence of RMF 90817.1 and carrying various mutation substitution sites (SEQ ID NOS:2237-2366). The mutation substitution sites are relative to the numbering in SEQ ID NO:2215 of wild type DNA polymerase having a backbone sequence of RMF 90817.1.

FIG. 146 (1 sheet) is Table 9 which lists the relative incorporation activity of mutant variants (SEQ ID NOS: 2368-2387) carrying various mutation substitution sites. Table 9 lists the incorporation activity of 3'methylazido nucleotides at the N+1 position of an extending polynucleotide chain at 42° C. The mutant variants are present in cleared lysates from expression strains. The mutation substitution sites are relative to the numbering in SEQ ID NO:2367 of wild type DNA polymerase having a backbone sequence of MBC 7218772.1.

FIG. 147 (1 sheet) is Table 10 which lists mutant DNA polymerases having a backbone sequence of MBC 7218772.1 and carrying various mutation substitution sites (SEQ ID NOS:2388-2392). The mutation substitution sites are relative to the numbering in SEQ ID NO:2367 of wild type DNA polymerase having a backbone sequence of MBC 7218772.1.

FIG. 148 (2 sheets) is Table 11 which lists mutant DNA polymerases having a backbone sequence of WP 175059460.1 and carrying various mutation substitution sites (SEQ ID NOS:2394-2407 and 2511-2523). The mutation substitution sites are relative to the numbering in SEQ ID NO:2393 of wild type DNA polymerase having a backbone sequence of WP 175059460.1.

FIG. 149 (1 sheet) is Table 12 which lists the relative incorporation activity of mutant variants carrying various mutation substitution sites (SEQ ID NOS:2409-2424). Table 12 lists the incorporation activity of 3'methylazido nucleotides at the N+1 position of an extending polynucleotide chain at 42° C. The mutant variants are present in cleared lysates from expression strains. The mutation substitution sites are relative to the numbering in SEQ ID NO:2408 of wild type DNA polymerase having a backbone sequence of KUO 42443.1.

FIG. 150 (1 sheet) is Table 13 which lists mutant DNA polymerases having a backbone sequence of KUO 42443.1 and carrying various mutation substitution sites (SEQ ID NOS:2425-2435). The mutation substitution sites are relative to the numbering in SEQ ID NO:2408 of wild type DNA polymerase having a backbone sequence of KUO 42443.1.

FIG. 151 (1 sheet) is Table 14 which lists mutant DNA polymerases having a backbone sequence of NOZ 77387.1 and carrying various mutation substitution sites (SEQ ID NOS:2437-2454). The mutation substitution sites are relative to the numbering in SEQ ID NO:2436 of wild type DNA polymerase having a backbone sequence of NOZ 77387.1.

FIG. 152 (2 sheets) is Table 15 which lists mutant DNA polymerases having a backbone sequence of Phi29 and carrying various mutation substitution sites (SEQ ID NOS: 2456-2501). The mutation substitution sites are relative to the numbering in SEQ ID NO:2455 of wild type DNA polymerase having a backbone sequence of Phi29.

FIG. 153 (5 sheets) shows amino acid sequence alignments of DNA polymerases from: RLF 89458.1 (SEQ ID NO:1); NOZ 58130 (SEQ ID NO:1316); RMF 90817 (SEQ ID NO:2215); MBC 7218772 (SEQ ID NO:2367); WP 175059460 (SEQ ID NO:2393); KUO 42443 (SEQ ID NO:2408); and NOZ 77387 (SEQ ID NO:2436).

FIG. 154 (5 sheets) shows amino acid sequence alignments of DNA polymerases from: RLF 89458.1 (SEQ ID NO:1); Geobacillus stearothermophilus (Bst polymerase) (SEQ ID NO:2502); 9° N (SEQ ID NO:2503); Pfu polymerase (SEQ ID NO:2508); and Pyrococcus abyssi polymerase (SEQ ID NO:2509).

FIG. 155 (5 sheets) shows amino acid sequence alignments of DNA polymerases from: NOZ 58130 (SEQ ID NO:1316); Geobacillus stearothermophilus (Bst polymerase) (SEQ ID NO:2502); 9° N (SEQ ID NO:2503); Pfu polymerase (SEQ ID NO:2508); and Pyrococcus abyssi polymerase (SEQ ID NO:2509).

FIG. 156 (5 sheets) shows amino acid sequence alignments of DNA polymerases from: RMF 90817 (SEQ ID NO:2215); Geobacillus stearothermophilus (Bst polymerase) (SEQ ID NO:2502); 9° N (SEQ ID NO:2503); Pfu polymerase (SEQ ID NO:2508); and Pyrococcus abyssi polymerase (SEQ ID NO:2509).

FIG. 157 (5 sheets) shows amino acid sequence alignments of DNA polymerases from: MBC 7218772 (SEQ ID NO:2367); Geobacillus stearothermophilus (Bst polymerase) (SEQ ID NO:2502); 9° N (SEQ ID NO:2503); Pfu polymerase (SEQ ID NO:2508); and Pyrococcus abyvssi polymerase (SEQ ID NO:2509).

FIG. 158 (5 sheets) shows amino acid sequence alignments of DNA polymerases from: WP 175059460 (SEQ ID NO:2393); Geobacillus stearothermophilus (Bst polymerase) (SEQ ID NO:2502); 9° N (SEQ ID NO:2503); Pfu polymerase (SEQ ID NO:2508); and Pyrococcus abyssi polymerase (SEQ ID NO:2509).

FIG. 159 (5 sheets) shows amino acid sequence alignments of DNA polymerases from: KUO 42443 (SEQ ID NO:2408); Geobacillus stearothermophilus (Bst polymerase) (SEQ ID NO:2502); 9° N (SEQ ID NO:2503); Pfu polymerase (SEQ ID NO:2508); and Pyrococcus abyssi polymerase (SEQ ID NO:2509).

FIG. 160 (5 sheets) shows amino acid sequence alignments of DNA polymerases from: NOZ 77387 (SEQ ID NO:2436); Geobacillus stearothermophilus (Bst polymerase) (SEQ ID NO:2502); 9° N (SEQ ID NO:2503); Pfu polymerase (SEQ ID NO:2508); and Pyrococcus abyssi polymerase (SEQ ID NO:2509).

Figure 161:
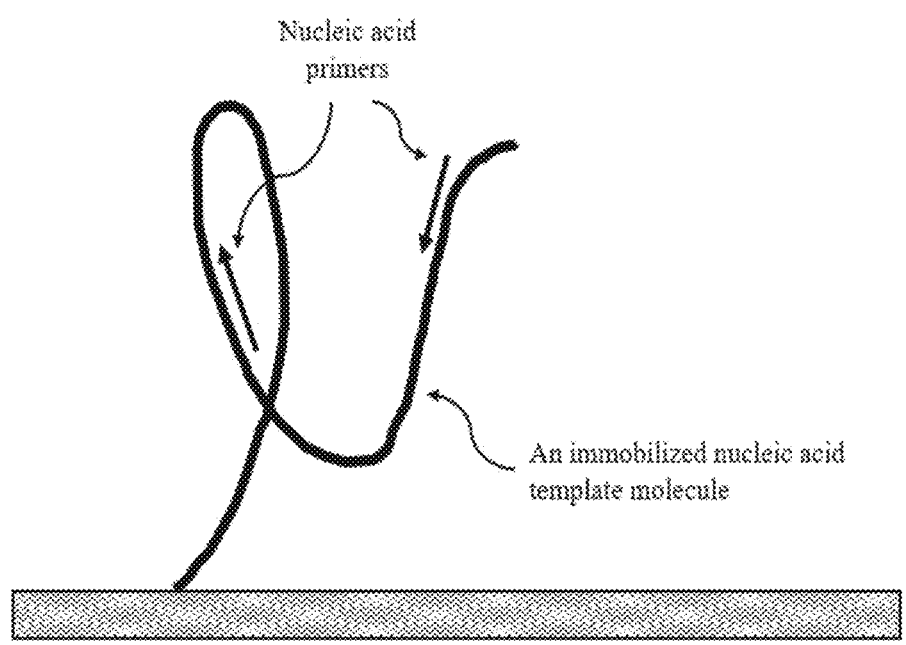

FIG. 161 is a schematic of an exemplary immobilized nucleic acid template molecule hybridized to a first and a second nucleic acid primer. The nucleic acid template molecule shown in FIG. 61 comprises a concatemer which is hybridized with a plurality of nucleic acid primers.

Figure 162:
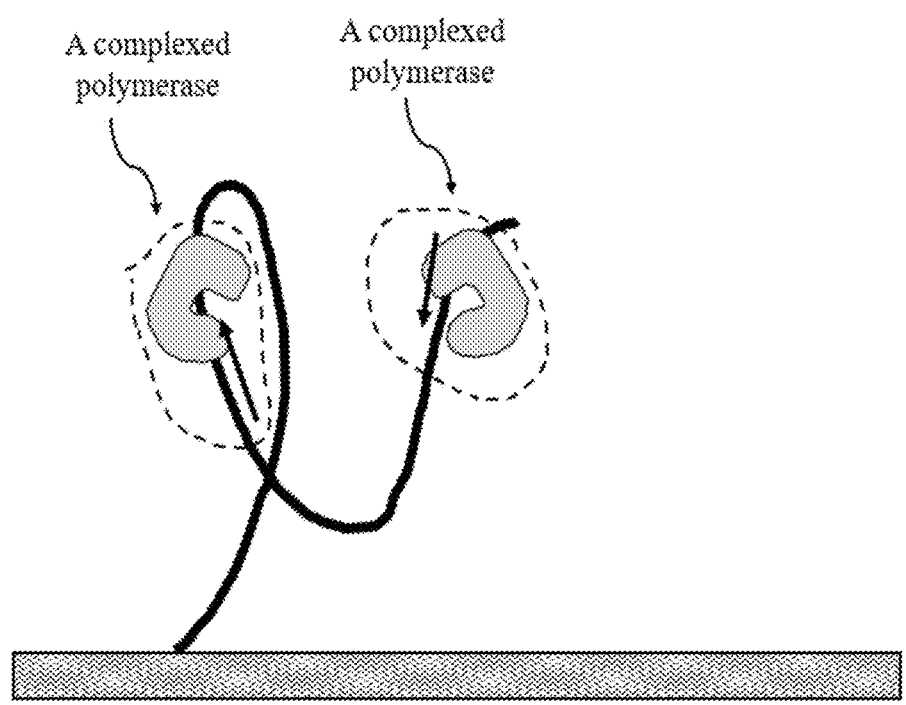

FIG. 162 is a schematic of exemplary complexed polymerases indicated by the dashed circles, where individual complexed polymerases comprise a DNA polymerase bound to nucleic acid duplex, where each duplex comprises a nucleic acid template hybridized to a nucleic acid primer.

Figure 163:
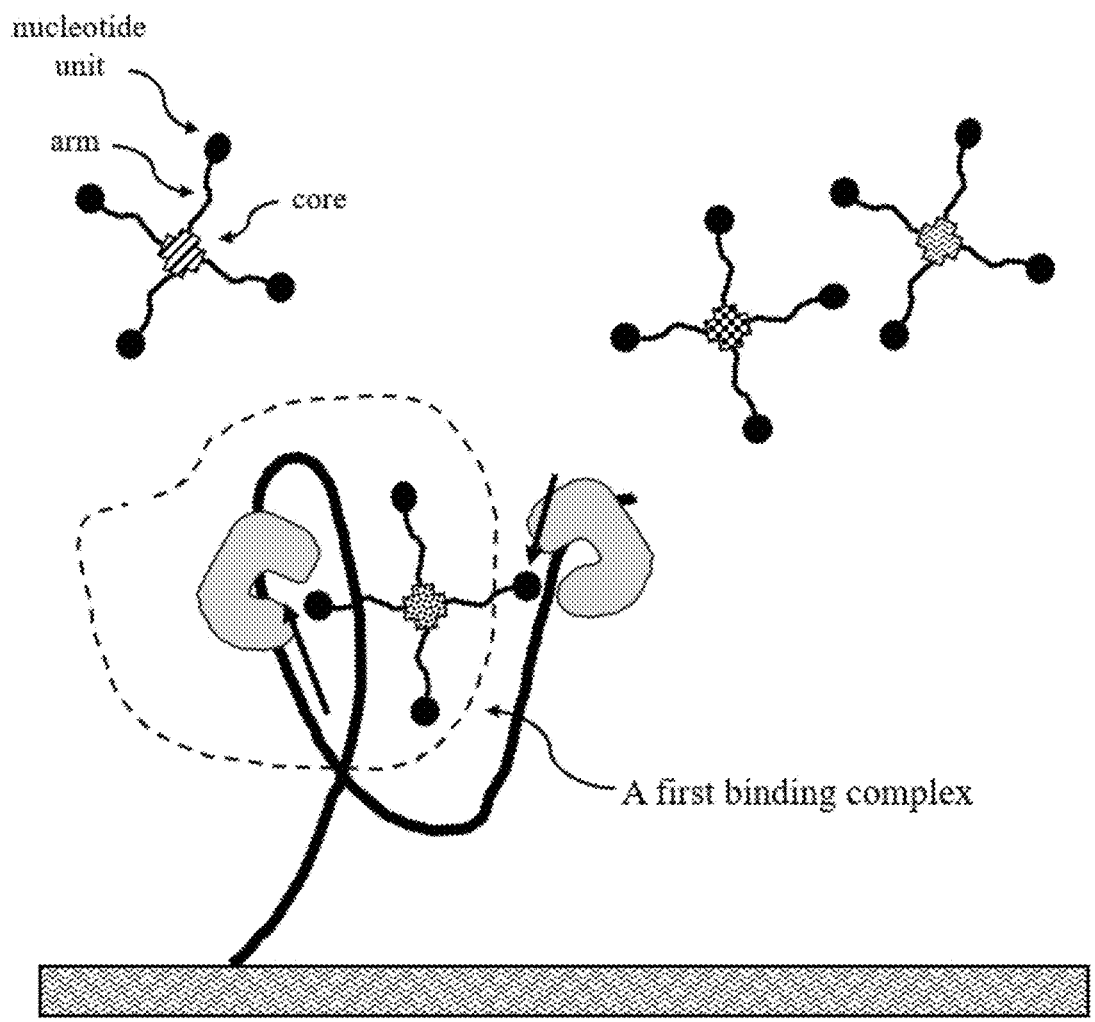

FIG. 163 is a schematic of an exemplary first binding complex (e.g., indicated by a dashed circle) comprising a first nucleic acid primer, a first DNA polymerase, and a first multivalent molecule bound to a first portion of a concatemer template molecule thereby forming a first binding complex. FIG. 63 also shows a plurality of multivalent molecules that are not part of the first binding complex.

Figure 164:
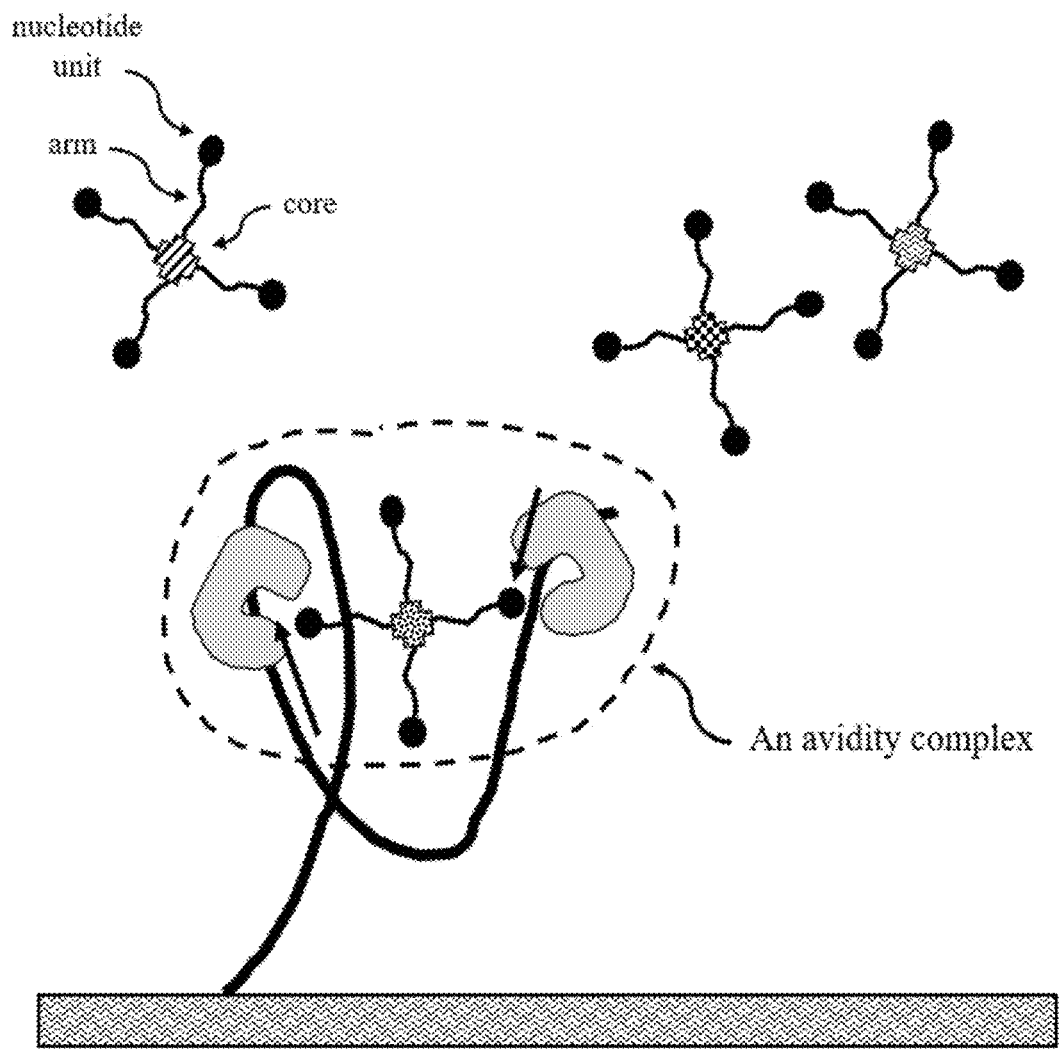

FIG. 164 is a schematic of an exemplary avidity complex (e.g., indicated by a dashed circle) comprising (i) a first binding complex which comprises a first nucleic acid primer, a first DNA polymerase, and a first multivalent molecule bound to a first portion of a concatemer template molecule thereby forming a first binding complex, wherein a first nucleotide unit of the multivalent molecule is bound to the first DNA polymerase, and (ii) the second binding complex which comprises a second nucleic acid primer, a second DNA polymerase, and the same first multivalent molecule bound to a second portion of the same concatemer template molecule thereby forming a second binding complex, wherein a second nucleotide unit of the multivalent molecule is bound to the second DNA polymerase, and wherein the first and second binding complexes which include the same multivalent molecule forms an avidity complex.

DETAILED DESCRIPTION

Definitions

The headings provided herein are not limitations of the various aspects of the disclosure, which aspects can be understood by reference to the specification as a whole.

Unless defined otherwise, technical and scientific terms used herein have meanings that are commonly understood by those of ordinary skill in the art unless defined otherwise. Generally, terminologies pertaining to techniques of molecular biology, nucleic acid chemistry, protein chemistry, genetics, microbiology, transgenic cell production, and hybridization described herein are those well-known and commonly used in the art. Techniques and procedures described herein are generally performed according to conventional methods well known in the art and as described in various general and more specific references that are cited and discussed throughout the instant specification. For example, see Sambrook et al., Molecular Cloning: A Laboratory Manual (Third ed., Cold Spring Harbor Laboratory Press, Cold Spring Harbor, N.Y. 2000). See also Ausubel et al., Current Protocols in Molecular Biology, Greene Publishing Associates (1992). The nomenclatures utilized in connection with, and the laboratory procedures and techniques described herein are those well-known and commonly used in the art.

Unless otherwise required by context herein, singular terms shall include pluralities and plural terms shall include the singular. Singular forms "a", "an" and "the", and singular use of any word, include plural referents unless expressly and unequivocally limited on one referent.

It is understood the use of the alternative term (e.g., "or") is taken to mean either one or both or any combination thereof of the alternatives.

The term "and/or" used herein is to be taken mean specific disclosure of each of the specified features or components with or without the other. For example, the term "and/or" as used in a phrase such as "A and/or B" herein is intended to include: "A and B"; "A or B"; "A" (A alone); and "B" (B alone). In a similar manner, the term "and/or" as used in a phrase such as "A, B, and/or C" is intended to encompass each of the following aspects: "A, B, and C"; "A, B, or C"; "A or C"; "A or B"; "B or C"; "A and B"; "B and C"; "A and C"; "A" (A alone); "B" (B alone); and "C" (C alone).

As used herein and in the appended claims, terms "comprising", "including", "having" and "containing", and their grammatical variants, as used herein are intended to be non-limiting so that one item or multiple items in a list do not exclude other items that can be substituted or added to the listed items. It is understood that wherever aspects are described herein with the language "comprising," otherwise analogous aspects described in terms of "consisting of" and/or "consisting essentially of" are also provided.

As used herein, the terms "about" and "approximately" refer to a value or composition that is within an acceptable error range for the particular value or composition as determined by one of ordinary skill in the art, which will depend in part on how the value or composition is measured or determined, i.e., the limitations of the measurement system. For example, "about" or "approximately" can mean within one or more than one standard deviation per the practice in the art. Alternatively, "about" or "approximately" can mean a range of up to 10% (i.e., +10%) or more depending on the limitations of the measurement system. For example, about 5 mg can include any number between 4.5 mg and 5.5 mg. Furthermore, particularly with respect to biological systems or processes, the terms can mean up to an order of magnitude or up to 5-fold of a value. When particular values or compositions are provided in the instant disclosure, unless otherwise stated, the meaning of "about" or "approximately" should be assumed to be within an acceptable error range for that particular value or composition. Also, where ranges and/or subranges of values are provided, the ranges and/or subranges can include the endpoints of the ranges and/or subranges.

The term "biological sample" refers to a single cell, a plurality of cells, a tissue, an organ, an organism, or section of any of these biological samples. The biological sample can be extracted (e.g., biopsied) from an organism, or obtained from a cell culture grown in liquid or in a culture dish. The biological sample comprises a sample that is fresh, frozen, fresh frozen, or archived (e.g., formalin-fixed paraffin-embedded; FFPE). The biological sample can be embedded in a wax, resin, epoxy or agar. The biological sample can be fixed, for example in any one or any combination of two or more of acetone, ethanol, methanol, formaldehyde, paraformaldehyde-Triton or glutaraldehyde. The biological sample can be sectioned or non-sectioned. The biological sample can be stained, de-stained or non-stained.

The nucleic acids of interest can be extracted from biological samples using any of a number of techniques known to those of skill in the art. For example, a typical DNA extraction procedure comprises (i) collection of the cell sample or tissue sample from which DNA is to be extracted, (ii) disruption of cell membranes (i.e., cell lysis) to release DNA and other cytoplasmic components, (iii) treatment of the lysed sample with a concentrated salt solution to precipitate proteins, lipids, and RNA, followed by centrifugation to separate out the precipitated proteins, lipids, and RNA, and (iv) purification of DNA from the supernatant to remove detergents, proteins, salts, or other reagents used during the cell membrane lysis. A variety of suitable commercial nucleic acid extraction and purification kits are consistent with the disclosure herein. Examples include, but are not limited to, the QIAamp® kits (for isolation of genomic DNA from human samples) and DNAeasy® kits (for isolation of genomic DNA from animal or plant samples) from Qiagen (Germantown, MD), or the Maxwell® and ReliaPrep™ series of kits from Promega (Madison, WI).

The terms "nucleic acid", "polynucleotide" and "oligonucleotide" and other related terms used herein are used interchangeably and refer to polymers of nucleotides and are not limited to any particular length. Nucleic acids include recombinant and chemically-synthesized forms. Nucleic acids can be isolated. Nucleic acids include DNA molecules (e.g., cDNA or genomic DNA), RNA molecules (e.g., mRNA), analogs of the DNA or RNA generated using nucleotide analogs (e.g., peptide nucleic acids (PNA) and non-naturally occurring nucleotide analogs), and chimeric forms containing DNA and RNA. Nucleic acids can be single-stranded or double-stranded. Nucleic acids comprise polymers of nucleotides, where the nucleotides include natural or non-natural bases and/or sugars. Nucleic acids comprise naturally-occurring internucleosidic linkages, for example phosphodiester linkages. Nucleic acids can lack a phosphate group. Nucleic acids comprise non-natural internucleoside linkages, including phosphorothioate, phosphorothiolate, or peptide nucleic acid (PNA) linkages. In some embodiments, nucleic acids comprise a one type of polynucleotides or a mixture of two or more different types of polynucleotides.

The term "universal sequence", "universal adaptor sequences" and related terms refers to a sequence in a nucleic acid molecule that is common among two or more polynucleotide molecules. For example, adaptors having the same universal sequence can be joined to a plurality of polynucleotides so that the population of co-joined molecules carry the same universal adaptor sequence. Examples of universal adaptor sequences include an amplification primer sequence, a sequencing primer sequence or a capture primer sequence (e.g., soluble or support-immobilized capture primers).

The term "operably linked" and "operably joined" or related terms as used herein refers to juxtaposition of components. The juxtapositioned components can be linked together covalently. For example, two nucleic acid components can be enzymatically ligated together where the linkage that joins together the two components comprises phosphodiester linkage. A first and second nucleic acid component can be linked together, where the first nucleic acid component can confer a function on a second nucleic acid component. For example, linkage between a primer binding sequence and a sequence of interest forms a nucleic acid library molecule having a portion that can bind to a primer. In another example, a transgene (e.g., a nucleic acid encoding a polypeptide or a nucleic acid sequence of interest) can be ligated to a vector where the linkage permits expression or functioning of the transgene sequence contained in the vector. In some embodiments, a transgene is operably linked to a host cell regulatory sequence (e.g., a promoter sequence) that affects expression of the transgene. In some embodiments, the vector comprises at least one host cell regulatory sequence, including a promoter sequence, enhancer, transcription and/or translation initiation sequence, transcription and/or translation termination sequence, polypeptide secretion signal sequences, and the like. In some embodiments, the host cell regulatory sequence controls expression of the level, timing and/or location of the transgene.

The terms "linked", "joined", "attached", "appended" and variants thereof comprise any type of fusion, bond, adherence or association between any combination of compounds or molecules that is of sufficient stability to withstand use in the particular procedure. The procedure can include but are not limited to: nucleotide binding; nucleotide incorporation; de-blocking (e.g., removal of chain-terminating moiety); washing; removing; flowing; detecting; imaging and/or identifying. Such linkage can comprise, for example, covalent, ionic, hydrogen, dipole-dipole, hydrophilic, hydrophobic, or affinity bonding, bonds or associations involving van der Waals forces, mechanical bonding, and the like. In some embodiments, such linkage occurs intramolecularly, for example linking together the ends of a single-stranded or double-stranded linear nucleic acid molecule to form a circular molecule. In some embodiments, such linkage can occur between a combination of different molecules, or between a molecule and a non-molecule, including but not limited to: linkage between a nucleic acid molecule and a solid surface; linkage between a protein and a detectable reporter moiety; linkage between a nucleotide and detectable reporter moiety; and the like. Some examples of linkages can be found, for example, in Hermanson, G., "Bioconjugate Techniques", Second Edition (2008); Aslam, M., Dent, A., "Bioconjugation: Protein Coupling Techniques for the Biomedical Sciences", London: Macmillan (1998); Aslam, M., Dent, A., "Bioconjugation: Protein Coupling Techniques for the Biomedical Sciences", London: Macmillan (1998).

The term "adaptor" and related terms refers to oligonucleotides that can be operably linked (appended) to a target polynucleotide, where the adaptor confers a function to the co-joined adaptor-target molecule. Adaptors comprise DNA, RNA, chimeric DNA/RNA, or analogs thereof. Adaptors can include at least one ribonucleoside residue. Adaptors can be single-stranded, double-stranded, or have single-stranded and/or double-stranded portions. Adaptors can be configured to be linear, stem-looped, hairpin, or Y-shaped forms. Adaptors can be any length, including 4-100 nucleotides or longer. Adaptors can have blunt ends, overhang ends, or a combination of both. Overhang ends include 5' overhang and 3' overhang ends. The 5' end of a single-stranded adaptor, or one strand of a double-stranded adaptor, can have a 5' phosphate group or lack a 5' phosphate group. Adaptors can include a 5' tail that does not hybridize to a target polynucleotide (e.g., tailed adaptor), or adaptors can be non-tailed. An adaptor can include a sequence that is complementary to at least a portion of a primer, such as an amplification primer, a sequencing primer, or a capture primer (e.g., soluble or immobilized capture primers). Adaptors can include a random sequence or degenerate sequence. Adaptors can include at least one inosine residue. Adaptors can include at least one phosphorothioate, phosphorothiolate and/or phosphoramidate linkage. Adaptors can include a barcode sequence which can be used to distinguish polynucleotides (e.g., insert sequences) from different sample sources in a multiplex assay. Adaptors can include a unique identification sequence (e.g., unique molecular index, UMI; or a unique molecular tag) that can be used to uniquely identify a nucleic acid molecule to which the adaptor is appended. In some embodiments, a unique identification sequence can be used to increase error correction and accuracy, reduce the rate of false-positive variant calls and/or increase sensitivity of variant detection. Adaptors can include at least one restriction enzyme recognition sequence, including any one or any combination of two or more selected from a group consisting of type I, type II, type III, type IV, type IIs or type IIB.

The term "nucleic acid template", "template polynucleotide", "nucleic acid target" "target polynucleotide", "template strand" and other variations refer to a nucleic acid strand that serves as the basis nucleic acid molecule for any of the analysis methods describe herein (e.g., primer extension, amplifying and/or sequencing). The template nucleic acid can be single-stranded or double-stranded, or the template nucleic acid can have single-stranded or double-stranded portions. The template nucleic acid can be obtained from a naturally-occurring source, recombinant form, or chemically synthesized to include any type of nucleic acid analog. The template nucleic acid can be linear, circular, or other forms. The template nucleic acids can include an insert region having an insert sequence which is also known as a sequence of interest. The template nucleic acids can also include at least one adaptor sequence. The template nucleic acid can be a concatemer having two or tandem copies of a sequence of interest and at least one adaptor sequence. The insert region can be isolated in any form, including chromosomal, genomic, organellar (e.g., mitochondrial, chloroplast or ribosomal), recombinant molecules, cloned, amplified, cDNA, RNA such as precursor mRNA or mRNA, oligonucleotides, whole genomic DNA, obtained from fresh frozen paraffin embedded tissue, needle biopsies, circulating tumor cells, cell free circulating DNA, or any type of nucleic acid library. The insert region can be isolated from any source including from organisms such as prokaryotes, eukaryotes (e.g., humans, plants and animals), fungus, viruses cells, tissues, normal or diseased cells or tissues, body fluids including blood, urine, serum, lymph, tumor, saliva, anal and vaginal secretions, amniotic samples, perspiration, semen, environmental samples, culture samples, or synthesized nucleic acid molecules prepared using recombinant molecular biology or chemical synthesis methods. The insert region can be isolated from any organ, including head, neck, brain, breast, ovary, cervix, colon, rectum, endometrium, gallbladder, intestines, bladder, prostate, testicles, liver, lung, kidney, esophagus, pancreas, thyroid, pituitary, thymus, skin, heart, larynx, or other organs. The template nucleic acid can be subjected to nucleic acid analysis, including sequencing and composition analysis.

The term "polymerase" and its variants, as used herein, comprises an enzyme comprising a domain that binds a nucleotide (or nucleoside) where the polymerase can form a complex having a template nucleic acid and a complementary nucleotide. The polymerase can have one or more activities including, but not limited to, base analog detection activities, DNA polymerization activity, reverse transcriptase activity, DNA binding, strand displacement activity, and nucleotide binding and recognition. A polymerase can be any enzyme that can catalyze polymerization of nucleotides (including analogs thereof) into a nucleic acid strand. Typically but not necessarily such nucleotide polymerization can occur in a template-dependent fashion. Typically, a polymerase comprises one or more active sites at which nucleotide binding and/or catalysis of nucleotide polymerization can occur. In some embodiments, a polymerase includes other enzymatic activities, such as for example, 3' to 5' exonuclease activity or 5' to 3' exonuclease activity. In some embodiments, a polymerase has strand displacing activity. A polymerase can include without limitation naturally occurring polymerases and any subunits and truncations thereof, mutant polymerases, variant polymerases, recombinant, fusion or otherwise engineered polymerases, chemically modified polymerases, synthetic molecules or assemblies, and any analogs, derivatives or fragments thereof that retain the ability to catalyze nucleotide polymerization (e.g., catalytically active fragment). The polymerase includes catalytically inactive polymerases, catalytically active polymerases, reverse transcriptases, and other enzymes comprising a nucleotide binding domain. In some embodiments, a polymerase can be isolated from a cell, or generated using recombinant DNA technology or chemical synthesis methods. In some embodiments, a polymerase can be expressed in prokaryote, eukaryote, viral, or phage organisms. In some embodiments, a polymerase can be post-translationally modified proteins or fragments thereof. A polymerase can be derived from a prokaryote, eukaryote, virus or phage. A polymerase comprises DNA-directed DNA polymerase and RNA-directed DNA polymerase.

The term "strand displacing" refers to the ability of a polymerase to locally separate strands of double-stranded nucleic acids and synthesize a new strand in a template-based manner. Strand displacing polymerases displace a complementary strand from a template strand and catalyze new strand synthesis. Strand displacing polymerases include mesophilic and thermophilic polymerases. Strand displacing polymerases include wild type enzymes, and variants including exonuclease minus mutants, mutant versions, chimeric enzymes and truncated enzymes. Examples of strand displacing polymerases include phi29 DNA polymerase, large fragment of Bst DNA polymerase, large fragment of Bsu DNA polymerase (exo-), Bca DNA polymerase (exo-), Klenow fragment of E. coli DNA polymerase, T5 polymerase, M-MuLV reverse transcriptase, HIV viral reverse transcriptase, Deep Vent® DNA polymerase and KOD DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio).

As used herein, the term "DNA primase-polymerase" and related terms refers to enzymes having activities of a DNA polymerase and an RNA primase. A DNA primase-polymerase enzyme can utilize deoxyribonucleotide triphosphates to synthesize a DNA primer on a single-stranded DNA template in a template-sequence dependent manner, and can extend the primer strand via nucleotide polymerization (e.g., primer extension), in the presence of a catalytic divalent cation (e.g., magnesium and/or manganese). The DNA primase-polymerase include enzymes that are members of DnaG-like primases (e.g., bacteria) and AEP-like primases (Archaea and Eukaryotes). An exemplary DNA primase-polymerase enzyme is Tth PrimPol from *Thermus thermophilus* HB27.

As used herein, the term "fidelity" refers to the accuracy of DNA polymerization by template-dependent DNA polymerase. The fidelity of a DNA polymerase is typically measured by the error rate (the frequency of incorporating an inaccurate nucleotide, i.e., a nucleotide that is not complementary to the template nucleotide). The accuracy or fidelity of DNA polymerization is maintained by both the polymerase activity and the 3'-5' exonuclease activity of a DNA polymerase.

As used herein, the term "binding complex" refers to a complex formed by binding together a nucleic acid duplex, a polymerase, and a free nucleotide or a nucleotide unit of a multivalent molecule, where the nucleic acid duplex comprises a nucleic acid template molecule hybridized to a nucleic acid primer. In the binding complex, the free nucleotide or nucleotide unit may or may not be bound to the 3' end of the nucleic acid primer at a position that is opposite a complementary nucleotide in the nucleic acid template molecule. A "ternary complex" is an example of a binding complex which is formed by binding together a nucleic acid duplex, a polymerase, and a free nucleotide or nucleotide unit of a multivalent molecule, where the free nucleotide or nucleotide unit is bound to the 3' end of the nucleic acid primer (as part of the nucleic acid duplex) at a position that is opposite a complementary nucleotide in the nucleic acid template molecule.

The term "persistence time" and related terms refers to the length of time that a binding complex remains stable without dissociation of any of the components, where the components of the binding complex include a nucleic acid template and nucleic acid primer, a polymerase, a nucleotide unit of a multivalent molecule or a free (e.g., unconjugated) nucleotide. The nucleotide unit or the free nucleotide can be complementary or non-complementary to a nucleotide residue in the template molecule. The nucleotide unit or the free nucleotide can bind to the 3' end of the nucleic acid primer at a position that is opposite a complementary nucleotide residue in the nucleic acid template molecule. The persistence time is indicative of the stability of the binding complex and strength of the binding interactions. Persistence time can be measured by observing the onset and/or duration of a binding complex, such as by observing a signal from a labeled component of the binding complex. For example, a labeled nucleotide or a labeled reagent comprising one or more nucleotides may be present in a binding complex, thus allowing the signal from the label to be detected during the persistence time of the binding complex. One exemplary label is a fluorescent label. The binding complex (e.g., ternary complex) remains stable until subjected to a condition that causes dissociation of interactions between any of the polymerase, template molecule, primer and/or the nucleotide unit or the nucleotide. For example, a dissociating condition comprises contacting the binding complex with any one or any combination of a detergent, EDTA and/or water.

The term "primer" and related terms used herein refers to an oligonucleotide that is capable of hybridizing with a DNA and/or RNA polynucleotide template to form a duplex molecule. Primers comprise natural nucleotides and/or nucleotide analogs. Primers can be recombinant nucleic acid molecules. Primers may have any length, but typically range from 4-50 nucleotides. A typical primer comprises a 5' end and 3' end. The 3' end of the primer can include a 3' OH moiety which serves as a nucleotide polymerization initiation site in a polymerase-catalyzed primer extension reaction. Alternatively, the 3' end of the primer can lack a 3' OH moiety, or can include a terminal 3' blocking group that inhibits nucleotide polymerization in a polymerase-catalyzed reaction. Any one nucleotide, or more than one nucleotide, along the length of the primer can be labeled with a detectable reporter moiety. A primer can be in solution (e.g., a soluble primer) or can be immobilized to a support (e.g., a capture primer).

When used in reference to nucleic acid molecules, the terms "hybridize" or "hybridizing" or "hybridization" or other related terms refers to hydrogen bonding between two different nucleic acids to form a duplex nucleic acid. Hybridization also includes hydrogen bonding between two different regions of a single nucleic acid molecule to form a self-hybridizing molecule having a duplex region. Hybridization can comprise Watson-Crick or Hoogstein binding to form a duplex double-stranded nucleic acid, or a double-stranded region within a nucleic acid molecule. The double-stranded nucleic acid, or the two different regions of a single nucleic acid, may be wholly complementary, or partially complementary. Complementary nucleic acid strands need not hybridize with each other across their entire length. The complementary base pairing can be the standard A-T or C-G base pairing, or can be other forms of base-pairing interactions. Duplex nucleic acids can include mismatched base-paired nucleotides.

When used in reference to nucleic acids, the terms "extend", "extending", "extension" and other variants, refers to incorporation of one or more nucleotides into a nucleic acid molecule. Nucleotide incorporation comprises polymerization of one or more nucleotides into the terminal 3' OH end of a nucleic acid strand (e.g., a nucleic acid primer), resulting in extension of the nucleic acid strand (e.g., extended primer). Nucleotide incorporation can be conducted with natural nucleotides and/or nucleotide analogs. Typically, but not necessarily, nucleotide incorporation occurs in a template-dependent fashion. Any suitable method of extending a nucleic acid molecule may be used, including primer extension catalyzed by a DNA polymerase or RNA polymerase.

In some embodiments, any of the amplification primer sequences, sequencing primer sequences, capture primer sequences (capture oligonucleotides), target capture sequences, circularization anchor sequences, sample barcode sequences, spatial barcode sequences, or anchor region sequences can be about 3-50 nucleotides in length, or about 5-40 nucleotides in length, or about 5-25 nucleotides in length.

The term "nucleotides" and related terms refers to a molecule comprising an aromatic base, a five carbon sugar (e.g., ribose or deoxyribose), and at least one phosphate group. Canonical or non-canonical nucleotides are consistent with use of the term. The phosphate in some embodiments comprises a monophosphate, diphosphate, or triphosphate, or corresponding phosphate analog. The term "nucleoside" refers to a molecule comprising an aromatic base and a sugar. Nucleotides and nucleosides can be non-labeled or labeled with a detectable reporter moiety.

Nucleotides (and nucleosides) typically comprise a hetero cyclic base including substituted or unsubstituted nitrogen-containing parent heteroaromatic ring which are commonly found in nucleic acids, including naturally-occurring, substituted, modified, or engineered variants, or analogs of the same. The base of a nucleotide (or nucleoside) is capable of forming Watson-Crick and/or Hoogstein hydrogen bonds with an appropriate complementary base. Exemplary bases include, but are not limited to, purines and pyrimidines such as: 2-aminopurine, 2,6-diaminopurine, adenine (A), etheno-adenine, $N^6$-$\Delta^2$-isopentenyladenine (6iA), $N^6$-$\Delta^2$-isopentenyl-2-methylthioadenine (2ms6iA), $N^6$-methyladenine, guanine (G), isoguanine, $N^2$-dimethylguanine (dmG), 7-methylguanine (7 mG), 2-thiopyrimidine, 6-thioguanine (6sG), hypoxanthine and $O^6$-methylguanine; 7-deaza-purines such as 7-deazaadenine (7-deaza-A) and 7-deazaguanine (7-deaza-G); pyrimidines such as cytosine (C), 5-propynylcytosine, isocytosine, thymine (T), 4-thiothymine (4sT), 5,6-dihydrothymine, $O^4$-methylthymine, uracil (U), 4-thiouracil (4sU) and 5,6-dihydrouracil (dihydrouracil; D); indoles such as nitroindole and 4-methylindole; pyrroles such as nitropyrrole; nebularine; inosines; hydroxymethylcytosines; 5-methycytosines; base (Y); as well as methylated, glycosylated, and acylated base moieties; and the like. Additional exemplary bases can be found in Fasman, 1989, in "Practical Handbook of Biochemistry and Molecular Biology", pp. 385-394, CRC Press, Boca Raton, Fla.

Nucleotides (and nucleosides) typically comprise a sugar moiety, such as carbocyclic moiety (Ferraro and Gotor 2000 Chem. Rev. 100: 4319-48), acyclic moieties (Martinez, et al., 1999 Nucleic Acids Research 27: 1271-1274; Martinez, et al., 1997 Bioorganic & Medicinal Chemistry Letters vol. 7: 3013-3016), and other sugar moieties (Joeng, et al., 1993 J. Med. Chem. 36: 2627-2638; Kim, et al., 1993 J. Med. Chem. 36: 30-7; Eschenmosser 1999 Science 284:2118-2124; and U.S. Pat. No. 5,558,991). The sugar moiety comprises: ribosyl; 2'-deoxyribosyl; 3'-deoxyribosyl; 2',3'-dideoxyribosyl; 2',3'-didehydrodideoxyribosyl; 2'-alkoxyribosyl; 2'-azidoribosyl; 2'-aminoribosyl; 2'-fluororibosyl; 2'-mercaptoriboxyl; 2'-alkylthioribosyl; 3'-alkoxyribosyl; 3'-azidoribosyl; 3'-aminoribosyl; 3'-fluororibosyl; 3'-mercaptoriboxyl; 3'-alkylthioribosyl carbocyclic; acyclic or other modified sugars.

In some embodiments, nucleotides comprise a chain of one, two or three phosphorus atoms where the chain is typically attached to the 5' carbon of the sugar moiety via an ester or phosphoramide linkage. In some embodiments, the nucleotide is an analog having a phosphorus chain in which the phosphorus atoms are linked together with intervening O, S, NH, methylene or ethylene. In some embodiments, the phosphorus atoms in the chain include substituted side groups including O, S or BH$_3$. In some embodiments, the chain includes phosphate groups substituted with analogs including phosphoramidate, phosphorothioate, phosphordithioate, and O-methylphosphoroamidite groups.

The term "reporter moiety", "reporter moieties" or related terms refers to a compound that generates, or causes to generate, a detectable signal. A reporter moiety is sometimes called a "label". Any suitable reporter moiety may be used, including luminescent, photoluminescent, electroluminescent, bioluminescent, chemiluminescent, fluorescent, phosphorescent, chromophore, radioisotope, electrochemical, mass spectrometry, Raman, hapten, affinity tag, atom, or an enzyme. A reporter moiety generates a detectable signal resulting from a chemical or physical change (e.g., heat, light, electrical, pH, salt concentration, enzymatic activity, or proximity events). A proximity event includes two reporter moieties approaching each other, or associating with each other, or binding each other. It is well known to one skilled in the art to select reporter moieties so that each absorbs excitation radiation and/or emits fluorescence at a wavelength distinguishable from the other reporter moieties to permit monitoring the presence of different reporter moieties in the same reaction or in different reactions. Two or more different reporter moieties can be selected having spectrally distinct emission profiles, or having minimal overlapping spectral emission profiles. Reporter moieties can be linked (e.g., operably linked) to nucleotides, nucleosides, nucleic acids, enzymes (e.g., polymerases or reverse transcriptases), or support (e.g., surfaces).

A reporter moiety (or label) comprises a fluorescent label or a fluorophore. Exemplary fluorescent moieties which may serve as fluorescent labels or fluorophores include, but are not limited to fluorescein and fluorescein derivatives such as carboxyfluorescein, tetrachlorofluorescein, hexachlorofluorescein, carboxynapthofluorescein, fluorescein isothiocyanate, NHS-fluorescein, iodoacetamidofluorescein, fluorescein maleimide, SAMSA-fluorescein, fluorescein thiosemicarbazide, carbohydrazinomethylthioacetyl-amino fluorescein, rhodamine and rhodamine derivatives such as TRITC, TMR, lissamine rhodamine, Texas Red, rhodamine B, rhodamine 6G, rhodamine 10, NHS-rhodamine, TMR-iodoacetamide, lissamine rhodamine B sulfonyl chloride, lissamine rhodamine B sulfonyl hydrazine, Texas Red sulfonyl chloride, Texas Red hydrazide, coumarin and coumarin derivatives such as AMCA, AMCA-NHS, AMCA-sulfo-NHS, AMCA-HPDP, DCIA, AMCE-hydrazide, BODIPY™ and derivatives such as BODIPY™ FL C3-SE, BODIPY™ 530/550 C3, BODIPY™ 530/550 C3-SE, BODIPY™ 530/550 C3 hydrazide, BODIPY™ 493/503 C3 hydrazide, BODIPY™ FL C3 hydrazide, BODIPY™ FL IA, BODIPY™ 530/551 IA, Br-BODIPY™ 493/503, Cascade Blue® and derivatives such as Cascade Blue® acetyl azide, Cascade Blue® cadaverine, Cascade Blue® ethylenediamine, Cascade Blue® hydrazide, Lucifer Yellow and derivatives such as Lucifer Yellow iodoacetamide, Lucifer Yellow CH, cyanine and derivatives such as indolium based cyanine dyes, benzo-indolium based cyanine dyes, pyridium based cyanine dyes, thiozolium based cyanine dyes, quinolinium based cyanine dyes, imidazolium based cyanine dyes, Cy 3, Cy5, lanthanide chelates and derivatives such as BCPDA, TBP, TMT, BHHCT, BCOT, Europium chelates, Terbium chelates, Alexa Fluor® dyes, DyLight® dyes, Atto dyes, LightCycler® Red dyes, CAL Flour dyes, JOE and derivatives thereof, Oregon Green™ dyes, WellRED dyes, IRD dyes, phycoerythrin and phycobilin dyes, Malachite green, stilbene, DEG dyes, NR dyes, near-infrared dyes and others known in the art such as those described in Haugland, Molecular Probes Handbook, (Eugene, Oreg.) 6th Edition; Lakowicz, Principles of Fluorescence Spectroscopy, 2nd Ed., Plenum Press New York (1999), or Hermanson, Bioconjugate Techniques, 2nd Edition, or derivatives thereof, or any combination thereof. Cyanine dyes may exist in either sulfonated or non-sulfonated forms, and consist of two indolenin, benzo-indolium, pyridium, thiozolium, and/or quinolinium groups separated by a polymethine bridge between two nitrogen atoms. Commercially available cyanine fluorophores include, for example, Cy3, (which may comprise 1-[6-(2,5-dioxopyrrolidin-1-yloxy)-6-oxohexyl]-2-(3-{1-[6-(2,5-dioxopyrrolidin-1-yloxy)-6-oxohexyl]-3,3-dimethyl-1,3-dihydro-2H-indol-2-ylidene}prop-1-en-1-yl)-3,3-dimethyl-3H-indolium or 1-[6-(2,5-dioxopyrrolidin-1-yloxy)-6-oxohexyl]-2-(3-{1-[6-(2,5-dioxopyrrolidin-1-yloxy)-6-oxohexyl]-3,3-dimethyl-5-sulfo-1,3-dihydro-2H-indol-2-ylidene}prop-1-en-1-yl)-3,3-dimethyl-3H-indolium-5-sulfonate), Cy5 (which may comprise 1-(6-((2,5-dioxopyrrolidin-1-yl)oxy)-6-oxohexyl)-2-((1E,3E)-5-((E)-1-(6-((2,5-dioxopyrrolidin-1-yl)oxy)-6-oxohexyl)-3,3-dimethyl-5-indolin-2-ylidene)penta-1,3-dien-1-yl)-3,3-dimethyl-3H-indol-1-ium or 1-(6-((2,5-dioxopyrrolidin-1-yl)oxy)-6-oxohexyl)-2-((1E,3E)-5-((E)-1-(6-((2,5-dioxopyrrolidin-1-yl)oxy)-6-oxohexyl)-3,3-dimethyl-5-sulfoindolin-2-ylidene)penta-1,3-dien-1-yl)-3,3-dimethyl-3H-indol-1-ium-5-sulfonate), and Cy7 (which may comprise 1-(5-carboxypentyl)-2-[(1E,3E,5E,7Z)-7-(1-ethyl-1,3-dihydro-2H-indol-2-ylidene)hepta-1,3,5-trien-1-yl]-3H-indolium or 1-(5-carboxypentyl)-2-[(1E,3E,5E,7Z)-7-(1-ethyl-5-sulfo-1,3-dihydro-2H-indol-2-ylidene)hepta-1,3,5-trien-1-yl]-3H-indolium-5-sulfonate), where "Cy" stands for 'cyanine', and the first digit identifies the number of carbon atoms between two indolenine groups. Cy2 which is an oxazole derivative rather than indolenin, and the benzo-derivatized Cy3.5, Cy5.5 and Cy7.5 are exceptions to this rule.

In some embodiments, the reporter moiety can be a FRET pair, such that multiple classifications can be performed under a single excitation and imaging step. As used herein, FRET may comprise excitation exchange (Forster) transfers, or electron-exchange (Dexter) transfers.

The term "support" as used herein refers to a substrate that is designed for deposition of biological molecules or biological samples for assays and/or analyses. Examples of biological molecules to be deposited onto a support include nucleic acids (e.g., DNA, RNA), polypeptides, saccharides, lipids, a single cell or multiple cells. Examples of biological samples include but are not limited to saliva, phlegm, mucus, blood, plasma, serum, urine, stool, sweat, tears and fluids from tissues or organs.

In some embodiments, the support is solid, semi-solid, or a combination of both. In some embodiments, the support is porous, semi-porous, non-porous, or any combination of porosity. In some embodiments, the support can be substantially planar, concave, convex, or any combination thereof. In some embodiments, the support can be cylindrical, for example comprising a capillary or interior surface of a capillary.

In some embodiments, the surface of the support can be substantially smooth. In some embodiments, the support can be regularly or irregularly textured, including bumps, etched, pores, three-dimensional scaffolds, or any combination thereof.

In some embodiments, the support comprises a bead having any shape, including spherical, hemi-spherical, cylindrical, barrel-shaped, toroidal, disc-shaped, rod-like, conical, triangular, cubical, polygonal, tubular or wire-like.

The support can be fabricated from any material, including but not limited to glass, fused-silica, silicon, a polymer (e.g., polystyrene (PS), macroporous polystyrene (MPPS), polymethylmethacrylate (PMMA), polycarbonate (PC), polypropylene (PP), polyethylene (PE), high density polyethylene (HDPE), cyclic olefin polymers (COP), cyclic olefin copolymers (COC), polyethylene terephthalate (PET)), or any combination thereof. Various compositions of both glass and plastic substrates are contemplated.

The support can have a plurality (e.g., two or more) of nucleic acid templates immobilized thereon. The plurality of immobilized nucleic acid templates have the same sequence or have different sequences. In some embodiments, individual nucleic acid template molecules in the plurality of nucleic acid templates are immobilized to a different site on the support. In some embodiments, two or more individual nucleic acid template molecules in the plurality of nucleic acid templates are immobilized to a site on the support.

The term "array" refers to a support comprising a plurality of sites located at pre-determined locations on the support to form an array of sites. The sites can be discrete and separated by interstitial regions. In some embodiments, the pre-determined sites on the support can be arranged in one dimension in a row or a column, or arranged in two dimensions in rows and columns. In some embodiments, the plurality of pre-determined sites is arranged on the support in an organized fashion. In some embodiments, the plurality of pre-determined sites is arranged in any organized pattern, including rectilinear, hexagonal patterns, grid patterns, patterns having reflective symmetry, patterns having rotational symmetry, or the like. The pitch between different pairs of sites can be that same or can vary. In some embodiments, the support comprises at least $10^2$ sites, at least $10^3$ sites, at least $10^4$ sites, at least $10^5$ sites, at least $10^6$ sites, at least $10^7$ sites, at least $10^8$ sites, at least $10^9$ sites, at least $10^{10}$ sites, at least $10^{11}$ sites, at least $10^{12}$ sites, at least $10^{13}$ sites, at least $10^{14}$ sites, at least $10^{15}$ sites, or more, where the sites are located at pre-determined locations on the support. In some embodiments, a plurality of pre-determined sites on the support (e.g., $10^2$-$10^{15}$ sites or more) are immobilized with nucleic acid templates to form a nucleic acid template array. In some embodiments, the nucleic acid templates that are immobilized at a plurality of pre-determined sites by hybridization to immobilized surface capture primers, or the nucleic acid templates are covalently attached to the surface capture primer. In some embodiments, the nucleic acid templates that are immobilized at a plurality of pre-determined sites, for example immobilized at $10^2$-$10^{15}$ sites or more. In some embodiments, the immobilized nucleic acid templates are clonally-amplified to generate immobilized nucleic acid polonies at the plurality of pre-determined sites. In some embodiments, individual immobilized nucleic acid polonies comprise single-stranded or double-stranded concatemers.

In some embodiments, a support comprising a plurality of sites located at random locations on the support is referred to herein as a support having randomly located sites thereon. The location of the randomly located sites on the support are not pre-determined. The plurality of randomly-located sites is arranged on the support in a disordered and/or unpredictable fashion. In some embodiments, the support comprises at least $10^2$ sites, at least $10^3$ sites, at least $10^4$ sites, at least $10^5$ sites, at least $10^6$ sites, at least $10^7$ sites, at least $10^8$ sites, at least $10^9$ sites, at least $10^{10}$ sites, at least $10^{11}$ sites, at least $10^{12}$ sites, at least $10^{13}$ sites, at least $10^{14}$ sites, at least $10^{15}$ sites, or more, where the sites are randomly located on the support. In some embodiments, a plurality of randomly located sites on the support (e.g., $10^2$-$10^{15}$ sites or more) are immobilized with nucleic acid templates to form a support immobilized with nucleic acid templates. In some embodiments, the nucleic acid templates that are immobilized at a plurality of randomly located sites by hybridization to immobilized surface capture primers, or the nucleic acid templates are covalently attached to the surface capture primer. In some embodiments, the nucleic acid templates that are immobilized at a plurality of randomly located sites, for example immobilized at $10^2$-$10^{15}$ sites or more. In some embodiments, the immobilized nucleic acid templates are clonally-amplified to generate immobilized nucleic acid polonies at the plurality of randomly located sites. In some embodiments, individual immobilized nucleic acid polonies comprise single-stranded or double-stranded concatemers.

When used in reference to a low binding surface coating, one or more layers of a multi-layered surface coating may comprise a branched polymer or may be linear. Examples of suitable branched polymers include, but are not limited to, branched PEG, branched poly(vinyl alcohol) (branched PVA), branched poly(vinyl pyridine), branched poly(vinyl pyrrolidone) (branched PVP), branched), poly(acrylic acid) (branched PAA), branched polyacrylamide, branched poly (N-isopropylacrylamide) (branched PNIPAM), branched poly(methyl methacrylate) (branched PMA), branched poly (2-hydroxylethyl methacrylate) (branched PHEMA), branched poly(oligo(ethylene glycol) methyl ether methacrylate) (branched POEGMA), branched polyglutamic acid (branched PGA), branched poly-lysine, branched poly-glucoside, and dextran.

In some embodiments, the branched polymers used to create one or more layers of any of the multi-layered surfaces disclosed herein may comprise at least 4 branches, at least 5 branches, at least 6 branches, at least 7 branches, at least 8 branches, at least 9 branches, at least 10 branches, at least 12 branches, at least 14 branches, at least 16 branches, at least 18 branches, at least 20 branches, at least 22 branches, at least 24 branches, at least 26 branches, at least 28 branches, at least 30 branches, at least 32 branches, at least 34 branches, at least 36 branches, at least 38 branches, or at least 40 branched.

Linear, branched, or multi-branched polymers used to create one or more layers of any of the multi-layered surfaces disclosed herein may have a molecular weight of at least 500, at least 1,000, at least 2,000, at least 3,000, at least 4,000, at least 5,000, at least 10,000, at least 15,000, at least 20,000, at least 25,000, at least 30,000, at least 35,000, at least 40,000, at least 45,000, or at least 50,000 daltons.

In some embodiments, e.g., wherein at least one layer of a multi-layered surface comprises a branched polymer, the number of covalent bonds between a branched polymer molecule of the layer being deposited and molecules of the previous layer may range from about one covalent linkage per molecule and about 32 covalent linkages per molecule. In some embodiments, the number of covalent bonds between a branched polymer molecule of the new layer and molecules of the previous layer may be at least 1, at least 2, at least 3, at least 4, at least 5, at least 6, at least 7, at least 8, at least 9, at least 10, at least 12, at least 14, at least 16, at least 18, at least 20, at least 22, at least 24, at least 26, at least 28, at least 30, or at least 32 covalent linkages per molecule.

Any reactive functional groups that remain following the coupling of a material layer to the surface may optionally be blocked by coupling a small, inert molecule using a high yield coupling chemistry. For example, in the case that amine coupling chemistry is used to attach a new material layer to the previous one, any residual amine groups may subsequently be acetylated or deactivated by coupling with a small amino acid such as glycine.

The number of layers of low non-specific binding material, e.g., a hydrophilic polymer material, deposited on the surface, may range from 1 to about 10. In some embodiments, the number of layers is at least 1, at least 2, at least 3, at least 4, at least 5, at least 6, at least 7, at least 8, at least 9, or at least 10. In some embodiments, the number of layers may be at most 10, at most 9, at most 8, at most 7, at most 6, at most 5, at most 4, at most 3, at most 2, or at most 1. Any of the lower and upper values described in this paragraph may be combined to form a range included within the present disclosure, for example, in some embodiments the number of layers may range from about 2 to about 4. In some embodiments, all of the layers may comprise the same material. In some embodiments, each layer may comprise a different material. In some embodiments, the plurality of layers may comprise a plurality of materials. In some embodiments at least one layer may comprise a branched polymer. In some embodiment, all of the layers may comprise a branched polymer.

One or more layers of low non-specific binding material may in some cases be deposited on and/or conjugated to the substrate surface using a polar protic solvent, a polar or polar aprotic solvent, a nonpolar solvent, or any combination thereof. In some embodiments the solvent used for layer deposition and/or coupling may comprise an alcohol (e.g., methanol, ethanol, propanol, etc.), another organic solvent (e.g., acetonitrile, dimethyl sulfoxide (DMSO), dimethyl formamide (DMF), etc.), water, an aqueous buffer solution (e.g., phosphate buffer, phosphate buffered saline, 3-(N-morpholino)propanesulfonic acid (MOPS), etc.), or any combination thereof. In some embodiments, an organic component of the solvent mixture used may comprise at least 1%, 5%, 10%, 15%, 20%, 25%, 30%, 35%, 40%, 45%, 50%, 55%, 60%, 70%, 75%, 80%, 85%, 90%, 95%, 98%, or 99% of the total, with the balance made up of water or an aqueous buffer solution. In some embodiments, an aqueous component of the solvent mixture used may comprise at least 1%, 5%, 10%, 15%, 20%, 25%, 30%, 35%, 40%, 45%, 50%, 55%, 60%, 70%, 75%, 80%, 85%, 90%, 95%, 98%, or 99% of the total, with the balance made up of an organic solvent. The pH of the solvent mixture used may be less than 6, about 6, 6.5, 7, 7.5, 8, 8.5, 9, or greater than pH 9.

The term "branched polymer" and related terms refers to a polymer having a plurality of functional groups that help conjugate a biologically active molecule such as a nucleotide, and the functional group can be either on the side chain of the polymer or directly attaches to a central core or central backbone of the polymer. The branched polymer can have linear backbone with one or more functional groups coming off the backbone for conjugation. The branched polymer can also be a polymer having one or more sidechains, wherein the side chain has a site suitable for conjugation. Examples of the functional group include but are limited to hydroxyl, ester, amine, carbonate, acetal, aldehyde, aldehyde hydrate, alkenyl, acrylate, methacrylate, acrylamide, active sulfone, hydrazide, thiol, alkanoic acid, acid halide, isocyanate, isothiocyanate, maleimide, vinylsulfone, dithiopyridine, vinylpyridine, iodoacetamide, epoxide, glyoxal, dione, mesylate, tosylate, and tresylate.

When used in reference to immobilized nucleic acids, the term "immobilized" and related terms refer to nucleic acid molecules that are attached to a support through covalent bond or non-covalent interaction, or attached to a coating on the support, or buried within a matrix formed by a coating on the support, where the nucleic acid molecules include surface capture primers, nucleic acid template molecules and extension products of capture primers. Extension products of capture primers includes nucleic acid concatemers that can form nucleic acid polonies.

In some embodiments, one or more nucleic acid templates are immobilized on the support, for example immobilized at the sites on the support. In some embodiments, the one or more nucleic acid templates are clonally-amplified. In some embodiments, the one or more nucleic acid templates are clonally-amplified off the support (e.g., in-solution) and then deposited onto the support and immobilized on the support. In some embodiments, the clonal amplification reaction of the one or more nucleic acid templates is conducted on the support resulting in immobilization on the support. In some embodiments, the one or more nucleic acid templates are clonally-amplified (e.g., in solution or on the support) using a nucleic acid amplification reaction, including any one or any combination of: polymerase chain reaction (PCR), multiple displacement amplification (MDA), transcription-mediated amplification (TMA), nucleic acid sequence-based amplification (NASBA), strand displacement amplification (SDA), real-time SDA, bridge amplification, isothermal bridge amplification, rolling circle amplification (RCA), circle-to-circle amplification, helicase-dependent amplification, recombinase-dependent amplification, and/or single-stranded binding (SSB) protein-dependent amplification.

The term "surface primer", "surface capture primer" and related terms refers to single-stranded oligonucleotides that are immobilized to a support and comprise a sequence that can hybridize to at least a portion of a nucleic acid template molecule. Surface primers can be used to immobilize template molecules to a support via hybridization. Surface primers can be immobilized to a support in a manner that resists primer removal during flowing, washing, aspirating, and changes in temperature, pH, salts, chemical and/or enzymatic conditions. Typically, but not necessarily, the 5' end of a surface primer can be immobilized to a support. Alternatively, an interior portion or the 3' end of a surface primer can be immobilized to a support.

The surface primers comprise DNA, RNA, or analogs thereof. The surface primers can include a combination of DNA and RNA. The sequence of surface primers can be wholly complementary or partially complementary along their length to at least a portion of the nucleic acid template molecule (e.g., linear or circular template molecules). A support can include a plurality of immobilized surface primers having the same sequence, or having two or more different sequences. Surface primers can be any length, for example 4-50 nucleotides, or 50-100 nucleotides, or 100-150 nucleotides, or longer lengths.

A surface primer can include a terminal 3' nucleotide having a sugar 3' OH moiety which is extendible for nucleotide polymerization (e.g., polymerase catalyzed polymerization). A surface primer can include a terminal 3' nucleotide having a moiety that blocks polymerase-catalyzed extension. A surface primer can include a terminal 3' nucleotide having the 3' sugar position linked to a chain-terminating moiety that inhibits nucleotide polymerization. The 3' chain-terminating moiety can be removed (e.g., de-blocked) to convert the 3' end to an extendible 3' OH end using a de-blocking agent. Examples of chain terminating moieties include alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group. Azide type chain terminating moieties including azide, azido and azidomethyl groups.

Examples of de-blocking agents include a phosphine compound, such as Tris(2-carboxyethyl)phosphine (TCEP) and bis-sulfo triphenyl phosphine (BS-TPP), for chain-terminating groups azide, azido and azidomethyl groups. Examples of de-blocking agents include tetrakis(triphenylphosphine) palladium(O) (Pd(PPh$_3$)$_4$) with piperidine, or with 2,3-Dichloro-5,6-dicyano-1,4-benzo-quinone (DDQ), for chain-terminating groups alkyl, alkenyl, alkynyl and allyl. Examples of a de-blocking agent includes Pd/C for chain-terminating groups aryl and benzyl. Examples of de-blocking agents include phosphine, beta-mercaptoethanol or dithiothritol (DTT), for chain-terminating groups amine, amide, keto, isocyanate, phosphate, thio and disulfide. Examples of de-blocking agents include potassium carbonate (K$_2$CO$_3$) in MeOH, triethylamine in pyridine, and Zn in acetic acid (AcOH), for carbonate chain-terminating groups. Examples of de-blocking agents include tetrabutylammonium fluoride, pyridine-HF, with ammonium fluoride, and triethylamine trihydrofluoride, for chain-terminating groups urea and silyl.

In some embodiment, the plurality of immobilized surface capture primers on the support are in fluid communication with each other to permit flowing a solution of reagents (e.g., linear or circular nucleic acid template molecules, soluble primers, enzymes, nucleotides, divalent cations, buffers, reagents and the like) onto the support so that the plurality of immobilized surface capture primers on the support can be essentially simultaneously reacted with the reagents in a massively parallel manner. In some embodiments, the fluid communication of the plurality of immobilized surface capture primers can be used to conduct nucleic acid amplification reactions (e.g., RCA, MDA, PCR and bridge amplification) essentially simultaneously on the plurality of immobilized surface capture primers.

In some embodiment, the plurality of immobilized single stranded nucleic acid concatemer template molecules on the support are in fluid communication with each other to permit flowing a solution of reagents (e.g., soluble primers, enzymes, nucleotides, divalent cations, buffers, reagents and the like) onto the support so that the plurality of immobilized concatemer template molecules on the support can be essentially simultaneously reacted with the reagents in a massively parallel manner. In some embodiments, the fluid communication of the plurality of immobilized single stranded nucleic acid concatemer template molecules can be used to conduct nucleotide binding assays and/or conduct nucleotide polymerization reactions (e.g., primer extension or sequencing) essentially simultaneously on the plurality of immobilized single stranded nucleic acid concatemer template molecules, and optionally to conduct detection and imaging for massively parallel sequencing.

When used in reference to nucleic acids, the terms "amplify", "amplifying", "amplification", and other related terms include producing multiple copies of an original polynucleotide template molecule, where the copies comprise a sequence that is complementary to the template sequence, or the copies comprise a sequence that is the same as the template sequence. In some embodiments, the copies comprise a sequence that is substantially identical to a template sequence, or is substantially identical to a sequence that is complementary to the template sequence.

The present disclosure provides various pH buffering agents. The full name of the pH buffering agents is listed herein.

The term "Tris" refers to a pH buffering agent Tris(hydroxymethyl)-aminomethane. The term "Tris-HCl" refers to a pH buffering agent Tris(hydroxymethyl)-aminomethane hydrochloride. The term "Tricine" refers to a pH buffering agent N-[tris(hydroxymethyl) methyl]glycine. The term "Bicine" refers to a pH buffering agent N,N-bis(2-hydroxyethyl)glycine. The term "Bis-Tris propane" refers to a pH buffering agent 1,3 Bis[tris(hydroxymethyl)methylamino] propane. The term "HEPES" refers to a pH buffering agent 4-(2-hydroxyethyl)-1-piperazineethanesulfonic acid. The term "MES" refers to a pH buffering agent 2-(N-morpholino)ethanesulfonic acid). The term "MOPS" refers to a pH buffering agent 3-(N-morpholino)propanesulfonic acid. The term "MOPSO" refers to a pH buffering agent 3-(N-morphiolino)-2-hydroxypropanesulfonic acid. The term "BES" refers to a pH buffering agent N,N-bis(2-hydroxyethyl)-2-aminoethanesulfonic acid. The term "TES" refers to a pH buffering agent 2-[(2-Hydroxy-1,1bis(hydroxymethyl) ethyl)amino]ethanesulfonic acid). The term "CAPS" refers to a pH buffering agent 3-(cyclohexylamino)-1-propanesuhinic acid. The term "TAPS" refers to a pH buffering agent N-[Tris(hydroxymethyl)methyl]-3-amino propane sulfonic acid. The term "TAPSO" refers to a pH buffering agent N-[Tris(hydroxymethyl)methyl]-3-amino-2-hyidroxypropansulfonic acid. The term "ACES" refers to a pH buffering agent N-(2-Acetamido)-2-aminoethanesulfonic acid. The term "PIPES" refers to a pH buffering agent piperazine-1,4-bis(2-ethanesulfonic acid.

INTRODUCTION

The present disclosure provides compositions and methods that employ the compositions for conducting pairwise sequencing and for generating concatemer template molecules for pairwise sequencing.

Pairwise sequencing comprises obtaining a first sequencing read of a first region of a first nucleic acid strand (e.g., sense strand), and obtaining a second sequencing read of a second region of a second nucleic acid strand that is complementary to the first stand (e.g., anti-sense strand), wherein the first and second strands correspond to two complementary strands of the same double stranded template molecule. The first sequencing read of the first sequenced region and the second sequencing read of the second sequenced region can having overlapping sequences which correspond to complementary sequences from the first and second strands of the double stranded template molecule. The first and second sequencing reads can be aligned so that the overlapping sequencing reads can yield sequence information of a paired region in the original double stranded nucleic acid source (e.g., a paired region in the genome), and the accuracy of the sequence information can be ascertained from the first and second sequencing reads with a high level of confidence. The first sequencing read of the first sequenced region and the second sequencing read of the second sequenced region do not necessarily have overlapping sequences in which case sequence information of a paired region in the original double stranded nucleic acid source cannot be ascertained with a high level of confidence. The first and second sequencing reads can initiate at one end of their respective template molecules, or can initiate at an internal position.

The compositions and methods for pairwise sequencing described herein offers several advantages which improves the quality of the sequencing data, including increased signal intensity which improves base call accuracy. The pairwise sequencing methods also saves time by obviating the need to prepare separate nucleic acid libraries each corresponding to the sense and anti-sense strands of the double stranded template molecule having the sequence of interest. Additionally, the pairwise sequencing methods generate and sequence the sense and anti-sense strands directly on the support/substrate used to conduct the sequencing reactions.

The present disclosure provides pairwise sequencing methods that employ a support having a plurality of surface primers immobilized thereon. The immobilized surface primers are in fluid communication with each other to permit flowing various solutions of linear or circular nucleic acid template molecules, soluble primers, enzymes, nucleotides, divalent cations, buffers, reagents, and the like, onto the support so that the plurality of immobilized surface primers (and products generated from the immobilized surface primers) react with the solutions in a massively parallel manner.

The present disclosure provides pairwise sequencing methods comprising the steps: (a) providing a plurality of single stranded nucleic acid concatemer template molecules immobilized to a support; (b) sequencing the plurality of immobilized concatemer template molecules with a first plurality of sequencing polymerases, a plurality of soluble forward sequencing primers and a first plurality of multivalent molecules, thereby generating a plurality of extended forward sequencing primer strands; (c) retaining the plurality of immobilized concatemer template molecules and replacing the plurality of extended forward sequencing primer strands with a plurality of forward extension strands that are hybridized to the retained immobilized concatemer template molecules by conducting a primer extension reaction; (d) removing the retained immobilized concatemer template molecules while retaining the plurality of forward extension strands; and (e) sequencing the plurality of retained forward extension strands with a second plurality of sequencing polymerases, a plurality of soluble reverse sequencing primers and a second plurality of multivalent molecules. In some embodiments, individual concatemer template molecules in the plurality are immobilized to a surface primer where the surface primer is immobilized to the support. In some embodiments, individual concatemer template molecules are covalently joined to a surface primer, or individual concatemer template molecules are hybridized to a surface primer. In some embodiments, the immobilized surface primer includes or lacks a nucleotide having a scissile moiety that can be cleaved to generate an abasic site in the surface primer. In some embodiments, the plurality of concatemer template molecules comprise at least one nucleotide having a scissile moiety that can be cleaved to generate an abasic site in the concatemer template molecule. In some embodiments, the plurality of concatemer template molecules lack a nucleotide having a scissile moiety. Exemplary nucleotides having a scissile moiety (e.g., in the surface primer or the concatemer template molecule) include uridine, 8-oxo-7,8-dihydrogunine and deoxyinosine.

In some embodiments, pairwise sequencing methods include a rolling circle amplification reaction which is conducted on-support by distributing a plurality of single stranded circular library molecules onto the support having a plurality of surface primers immobilized thereon. Individual surface primers are designed to capture, via hybridization, a single circular library molecule. The rolling circle amplification reaction can be conducted on the support. In some embodiments, for the on-support RCA reaction, a solution of single stranded circular library molecules is flowed onto the support so that individual circular molecules are captured via hybridization to individual surface primers. Individual circular library molecules include at least a sequence of interest and a universal surface primer binding site, and optionally include universal sequencing primer binding sites, universal amplification primer binding site, an additional surface primer binding site, and a sample barcode and/or a molecular index. A single immobilized surface primer will capture a single circular library molecule and the rolling circle amplification reaction generates a single stranded linear concatemer that is covalently linked to the immobilized surface primer by employing the terminal 3' end of the surface primer as a primer extension initiation site. Thus, individual concatemer molecules are immobilized to the support as concatemers that are covalently linked to an immobilized surface primer. The single stranded concatemer includes multiple tandem copies of the sequence of interest and the universal sequencing primer binding sites. A single surface primer will capture a single circular library molecule and generate a single concatemer molecule.

In some embodiments, pairwise sequencing methods include a rolling circle amplification reaction which is conducted in-solution to generate a plurality of concatemers which are distributed onto the support having a plurality of surface primers immobilized thereon. Individual surface primers are designed to capture, via hybridization, a single concatemer having complementary sequences of the circular library molecules. The rolling circle amplification reaction can continue on the support. In some embodiments, for the in-solution RCA reaction, a plurality of single stranded circular library molecules are subjected to a rolling circle amplification reaction in a reaction vessel. Individual circular library molecules include at least a sequence of interest and a universal surface primer binding site, and optionally include universal sequencing primer binding sites, universal amplification primer binding site, an additional surface primer binding site, and a sample barcode and/or a molecular index. The RCA reaction can be conducted for a very short period of time or can be conducted for longer periods of time, to generate a plurality of concatemers hybridized to their respective circular library molecules which are then distributed onto the support having a plurality of surface primers immobilized thereon. A solution of concatemer molecules is flowed onto the support so that individual concatemer molecules are captured via hybridization to individual surface primers. Individual concatemer molecules include at least a sequence of interest, universal surface primer binding site(s), universal sequencing primer binding sites, and optionally a sample barcode and/or a molecular index. A single immobilized surface primer will capture a single concatemer molecule and the rolling circle amplification reaction (now on the support) continues thereby extending the single stranded concatemer that is hybridized to the immobilized surface primer. Thus, individual concatemer molecules are immobilized to the support as concatemers that are hybridized to an immobilized surface primer. The single stranded concatemer includes multiple tandem copies of the sequence of interest and the universal sequencing primer binding sites. A single surface primer will capture a single concatemer molecule and generate a single extended concatemer molecule.

The rolling circle amplification reaction, conducted either by in-solution or on-support, will generate concatemers that are immobilized to the support. Immobilized concatemers offer several advantages compared to non-concatemer molecules. The number of tandem copies in the concatemer is tunable by controlling the time, temperature and concentration of reagents of the in-solution or on-support rolling circle amplification reaction. The concatemer can self-collapse into a compact nucleic acid nanoball. Inclusion of one or more compaction oligonucleotides during the RCA reaction can further compact the size and/or shape of the nanoball. An increase in the number of tandem copies in a given concatemer increases the number of sites along the concatemer for hybridizing to multiple sequencing primers which serve as multiple initiation sites for polymerase-catalyzed sequencing reactions. When the sequencing reaction employs detectably labeled nucleotides and/or detectably labeled multivalent molecules (e.g., having nucleotide units), the signals emitted by the nucleotides or nucleotide units that participate in the parallel sequencing reactions along the concatemer yields an increased signal intensity for each concatemer. Multiple portions of a given concatemer can be simultaneously sequenced. Furthermore, a plurality of binding complexes can form along a particular concatemer molecule, each binding complex comprising a sequencing polymerase bound to a multivalent molecule wherein the plurality of binding complexes remain stable without dissociation resulting in increased persistence time which increases signal intensity and reduces imaging time.

The level of sequencing accuracy can be further improved by obtaining partially or wholly overlapping sequencing reads from both sense and anti-sense strands, and aligning the sequencing reads which provides redundant sequencing data.

Thus, the pairwise sequencing compositions and methods described herein provide improved sequencing data quality in a massively parallel manner.

Methods for Pairwise Sequencing—Generating Abasic Sites

The present disclosure provides pairwise sequencing methods, comprising step (a): providing a plurality of immobilized single stranded nucleic acid concatemer template molecules each comprising at least one nucleotide having a scissile moiety, wherein individual concatemer template molecules in the plurality are immobilized to a first surface primer that is immobilized to a support, and wherein the immobilized first surface primer lacks a nucleotide having a scissile moiety. In some embodiments, the support comprises a plurality of first surface primers. In some embodiments, the support lacks a plurality of second surface primers. In some embodiments, the support comprises a plurality of first and second surface primers.

Figure 1:
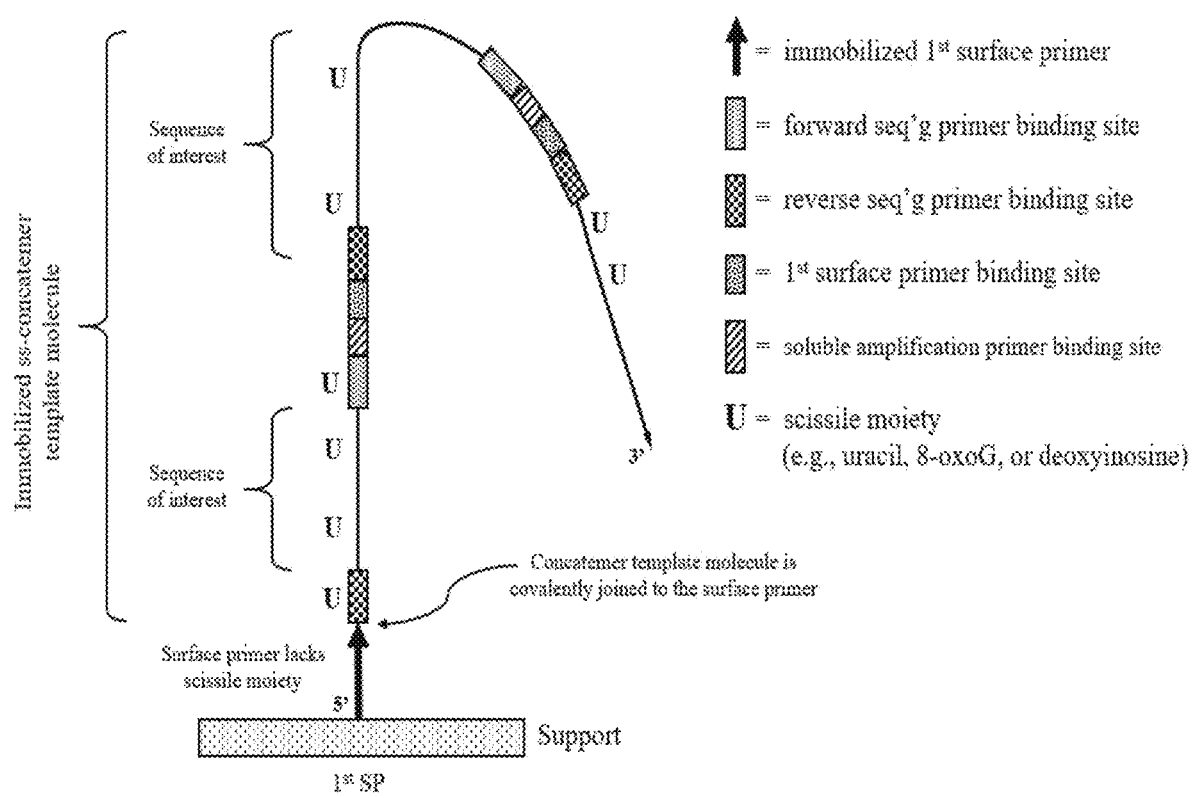
FIG. 1 is a schematic showing an exemplary single stranded nucleic acid concatemer template molecule immobilized to an immobilized first surface primer. The immobilized concatemer template molecule comprises at least one nucleotide having a scissile moiety that can be cleaved to generate an abasic site in the immobilized concatemer template molecule. In some embodiments, the immobilized concatemer template molecule can be generated by conducting an on-support rolling circle amplification reaction. The arrangement of the various primer binding sequences is for illustration purposes. The skilled artisan will appreciate that many other arrangements are possible.
Figure 13:
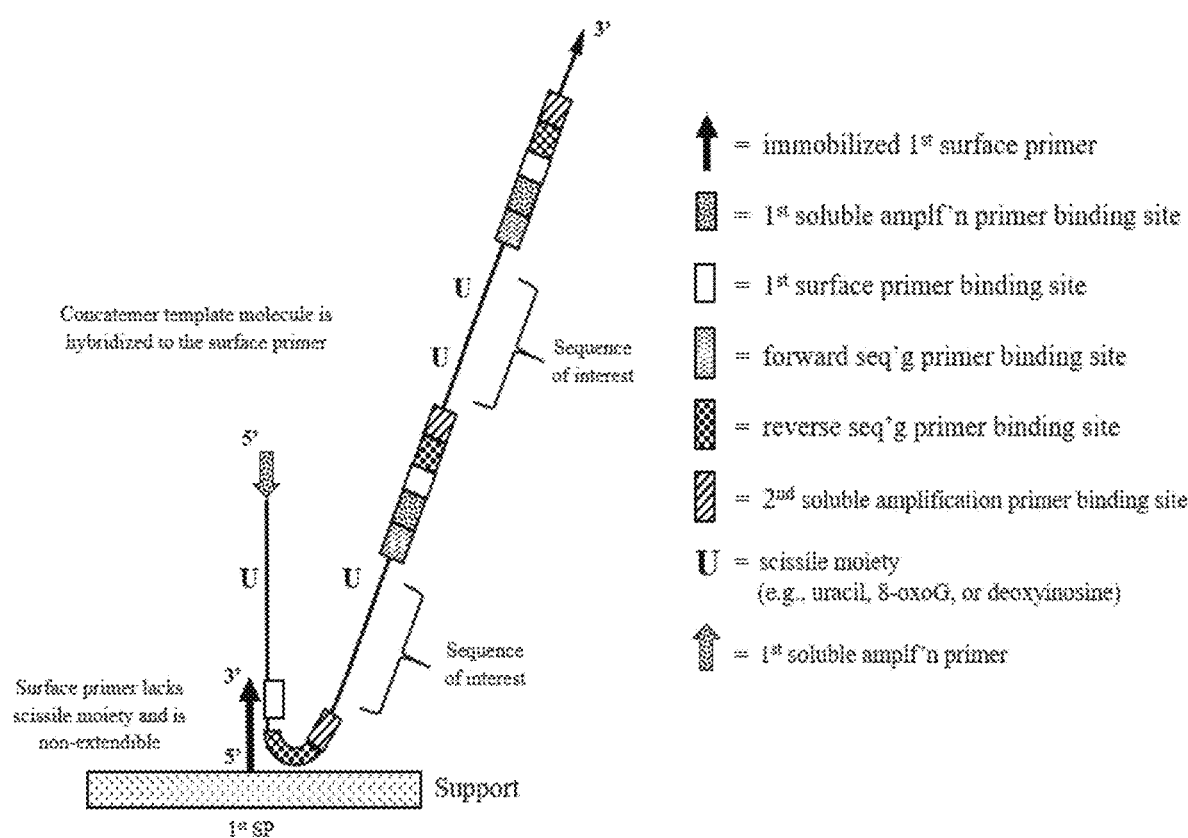
FIG. 13 is a schematic showing an exemplary single stranded nucleic acid concatemer template molecule immobilized to an immobilized first surface primer. The immobilized concatemer template molecule comprises at least one nucleotide having a scissile moiety that can be cleaved to generate an abasic site in the immobilized concatemer template molecule. In some embodiments, the immobilized concatemer template molecule can be generated by conducting an in-solution rolling circle amplification reaction and distributing the rolling circle amplification reaction onto the support. The arrangement of the various primer binding sequences is for illustration purposes. The skilled artisan will appreciate that many other arrangements are possible.

In some embodiments, individual immobilized concatemer template molecules are covalently joined to an immobilized surface primer (e.g., an immobilized first surface primer) (FIG. 1). In an alternative embodiment, individual immobilized concatemer template molecules are hybridized to an immobilized surface primer (e.g., an immobilized first surface primer) (FIG. 13).

In some embodiments, individual concatemer template molecules in the plurality comprise two or more copies of a sequence of interest, and wherein the individual immobilized concatemer template molecules further comprise any one or any combination of two or more of: (i) two or more copies of a universal binding sequence for a soluble forward sequencing primer, (ii) two or more copies of a universal binding sequence for a soluble reverse sequencing primer, (iii) two or more copies of a universal binding sequence for an immobilized first surface primer, (iv) two or more copies of a universal binding sequence for an immobilized second surface primer, (v) two or more copies of a universal binding sequence for a first soluble amplification primer, (vi) two or more copies of a universal binding sequence for a second soluble amplification primer, (vii) two or more copies of a universal binding sequence for a soluble compaction oligonucleotide, (viii) two or more copies of a sample barcode sequence and/or (ix) two or more copies of a unique molecular index sequence.

In some embodiments, the universal binding sequence (or a complementary sequence thereof) for the forward sequencing primer can hybridize to at least a portion of the forward sequencing primer. In some embodiments, the universal binding sequence (or a complementary sequence thereof) for the reverse sequencing primer can hybridize to at least a portion of the reverse sequencing primer. In some embodiments, the universal binding sequence (or a complementary sequence thereof) for the immobilized first surface primer can hybridize to at least a portion of the immobilized first surface primer. In some embodiments, the universal binding sequence (or a complementary sequence thereof) for the immobilized second surface primer can hybridize to at least a portion of the immobilized second surface primer. In some embodiments, the universal binding sequence (or a complementary sequence thereof) for the first soluble amplification primer can hybridize to at least a portion of the first soluble amplification primer. In some embodiments, the universal binding sequence (or a complementary sequence thereof) for the second soluble amplification primer can hybridize to at least a portion of the second soluble amplification primer. In some embodiments, the universal binding sequence (or a complementary sequence thereof) for the soluble compaction oligonucleotide can hybridize to at least a portion of the soluble compaction oligonucleotide.

In some embodiments, the scissile moiety in the immobilized concatemer template molecules of step (a) can be converted into abasic sites in the immobilized concatemer template molecules. In some embodiments, the scissile moiety in the immobilized concatemer template molecules comprises uridine, 8-oxo-7,8-dihydroguanine (e.g., 8oxoG) or deoxyinosine. In the concatemer template molecules, the uridine can be converted to an abasic site using uracil DNA glycosylase (UDG), the 8oxoG can be converted to an abasic site using FPG glycosylase, and the deoxyinosine can be converted to an abasic site using AlkA glycosylase. In some embodiments, the immobilized concatemer template molecules include 1-20, 20-40, 40-60, 60-80, 80-100, or a higher number of nucleotides with a scissile moiety. In some embodiments, about 0.1-1%, or about 1-5%, or about 5-10%, or about 10-20%, or about 20-30% or a higher percent of the dTTP in the immobilized concatemer template molecules are replaced with nucleotides having a scissile moiety. In some embodiments, the nucleotides having a scissile moiety are distributed at random positions along individual immobilized concatemer template molecules. In some embodiments, the nucleotides having a scissile moiety are distributed at different positions in the different immobilized concatemer template molecules.

In some embodiments, the immobilized first surface primers comprise single stranded oligonucleotides comprising DNA, RNA or a combination of DNA and RNA. The immobilized first surface primers can be immobilized to the support or immobilized to a coating on the support. The immobilized first surface primers can be embedded and attached (coupled) to the coating on the support. In some embodiments, the 5' end of the immobilized first surface primers are immobilized to a support or immobilized to a coating on the support. Alternatively, an interior portion or the 3' end of the immobilized first surface primers can be immobilized to a support or immobilized to a coating on the support. The support comprises a plurality of immobilized first surface primers having the same sequence. The immobilized first surface primers can be any length, for example 4-50 nucleotides, or 50-100 nucleotides, or 100-150 nucleotides, or longer lengths. In some embodiments, the 3' terminal end of the immobilized first surface primers comprise an extendible 3' OH moiety. In some embodiments, the 3' terminal end of the immobilized first surface primers comprise a 3' non-extendible moiety.

In some embodiments, the plurality of immobilized first surface primers comprise at least one phosphorothioate diester bond at their 5' ends which can render the first surface primers resistant to exonuclease degradation. In some embodiments, the plurality of immobilized first surface primers comprise 2-5 or more consecutive phosphorothioate diester bonds at their 5' ends. In some embodiments, the plurality of immobilized first surface primers comprise at least one ribonucleotide and/or at least one 2'-O-methyl or 2'-O-methoxyethyl (MOE) nucleotide which can render the first surface primers resistant to exonuclease degradation.

In some embodiments, the immobilized first surface primers comprise at least one locked nucleic acid (LNA) which comprises a methylene bridge bond between a 2' oxygen and 4' carbon of the pentose ring. Immobilized first surface primers that include at least one LNA can be resistant to nuclease digestions and can exhibit increased melting temperature when hybridized to the forward extension strand.

In some embodiments, the immobilized concatemer template molecules further comprise two or more copies of a universal binding sequence (or complementary sequence thereof) for an immobilized second surface primer having a sequence that differs from the first immobilized surface primer. The immobilized second surface primers of step (a) comprise single stranded oligonucleotides comprising DNA, RNA or a combination of DNA and RNA. The immobilized second surface primers can be immobilized to the support or immobilized to a coating on the support. The immobilized second surface primers can be embedded and attached (coupled) to the coating on the support. In some embodiments, the 5' end of the immobilized second surface primers are immobilized to a support or immobilized to a coating on the support. Alternatively, an interior portion or the 3' end of the immobilized second surface primers can be immobilized to a support or immobilized to a coating on the support. The support comprises a plurality of immobilized second surface primers having the same sequence. The immobilized second surface primers can be any length, for example 4-50 nucleotides, or 50-100 nucleotides, or 100-150 nucleotides, or longer lengths.

In some embodiments, the 3' terminal end of the immobilized second surface primers comprise an extendible 3' OH moiety. In some embodiments, the 3' terminal end of the immobilized second surface primers comprise a 3' non-extendible moiety. In some embodiments, the 3' terminal end of the immobilized second surface primers comprise a moiety that blocks primer extension (e.g., non-extendible terminal 3' end), such as for example a phosphate group, a dideoxycytidine group, an inverted dT, or an amino group. The immobilized second surface primers are not extendible in a primer extension reaction. The immobilized second surface primers lack a nucleotide having a scissile moiety.

In some embodiments, the plurality of immobilized second surface primers comprise at least one phosphorothioate diester bond at their 5' ends which can render the second surface primers resistant to exonuclease degradation. In some embodiments, the plurality of immobilized second surface primers comprise 2-5 or more consecutive phosphorothioate diester bonds at their 5' ends. In some embodiments, the plurality of immobilized second surface primers comprise at least one ribonucleotide and/or at least one 2'-O-methyl or 2'-O-methoxyethyl (MOE) nucleotide which can render the second surface primers resistant to exonuclease degradation.

Figure 12:
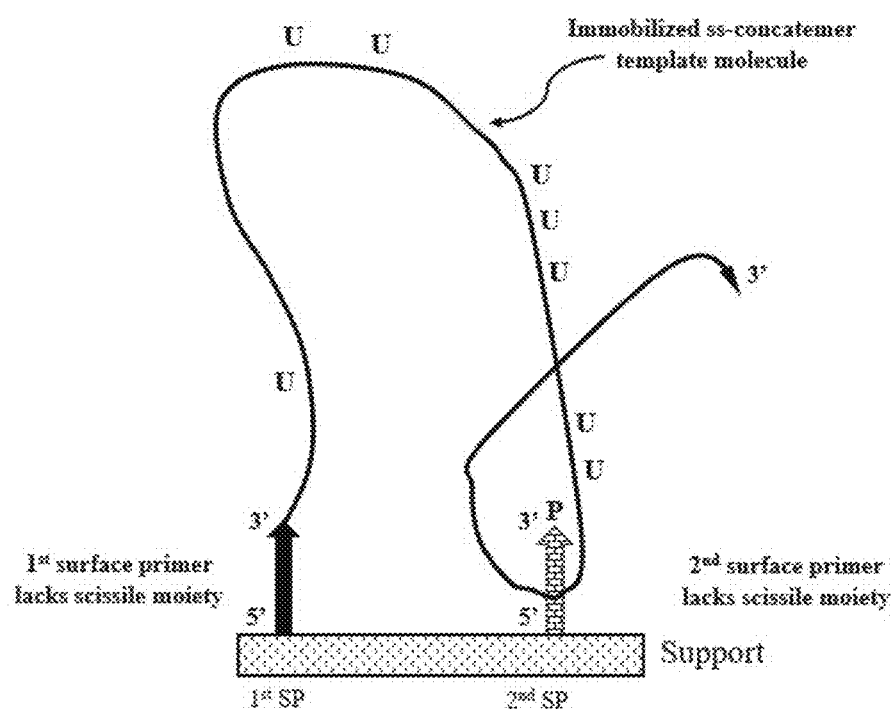
Figure 24:
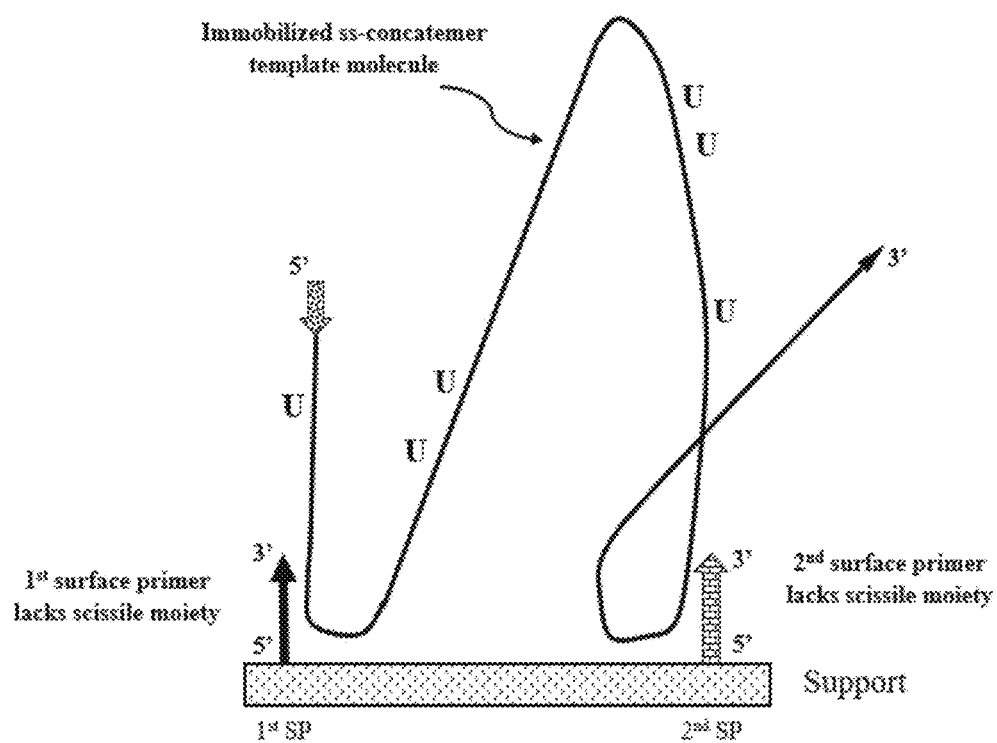

In some embodiments, individual immobilized single stranded nucleic acid concatemer template molecule are joined or immobilized to an immobilized first surface primer, and at least one portion of the individual concatemer template molecule is hybridized to an immobilized second surface primer. The immobilized second surface primers serve to pin down a portion of the immobilized concatemer template molecules to the support (see FIGS. 12 and 24).

In some embodiments, the support comprises about $10^2$-$10^{15}$ immobilized first surface primers per mm². In some embodiments, the support comprises about $10^2$-$10^{15}$ immobilized second surface primers per mm². In some embodiments, the support comprises about $10^2$-$10^{15}$ immobilized first surface primers and immobilized second surface primers per mm.

The immobilized surface primers (e.g., first and second surface primers) are in fluid communication with each other to permit flowing various solutions of linear or circular nucleic acid template molecules, soluble primers, enzymes, nucleotides, divalent cations, buffers, reagents, and the like, onto the support so that the plurality of immobilized surface primers (and the primer extension products generated from the immobilized surface primers) react with the solutions in a massively parallel manner.

Figure 2:
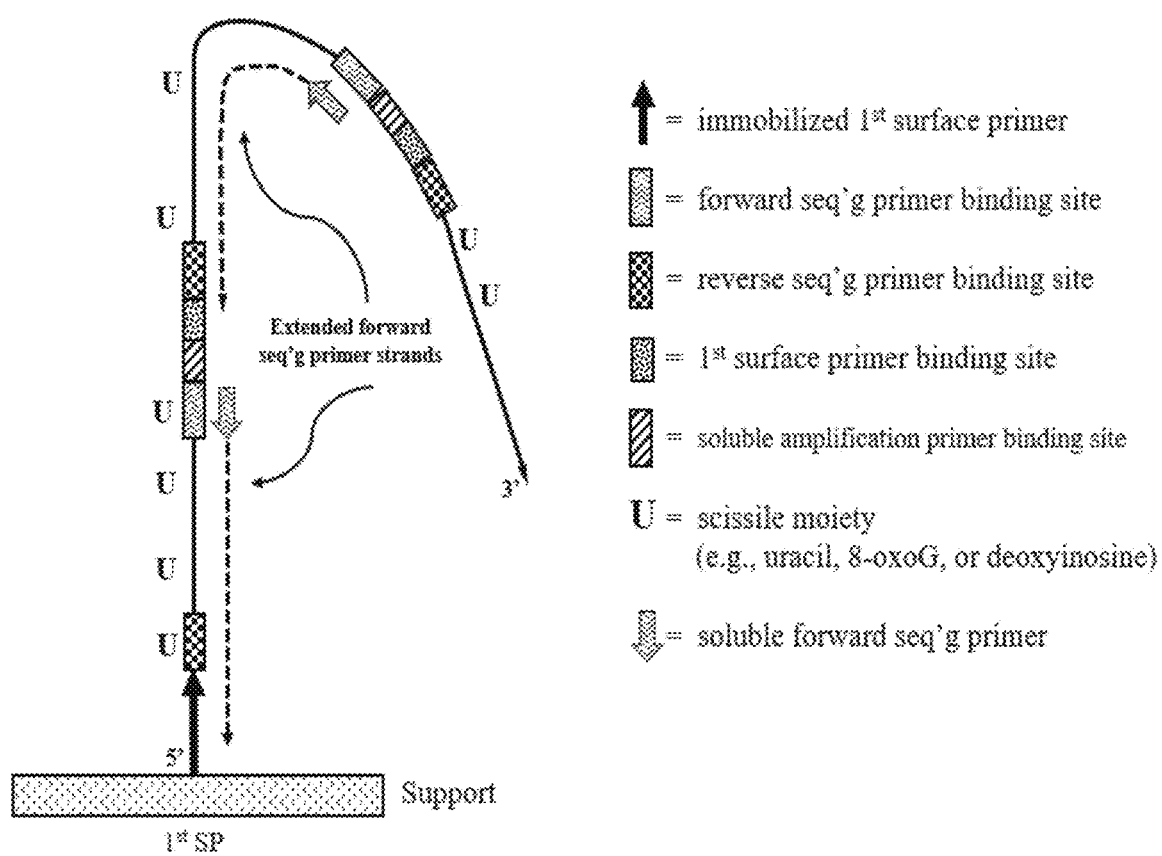
FIGS. 2-12 show the workflow of pairwise sequencing the immobilized concatemer template molecule depicted in FIG. 1.
Figure 14:
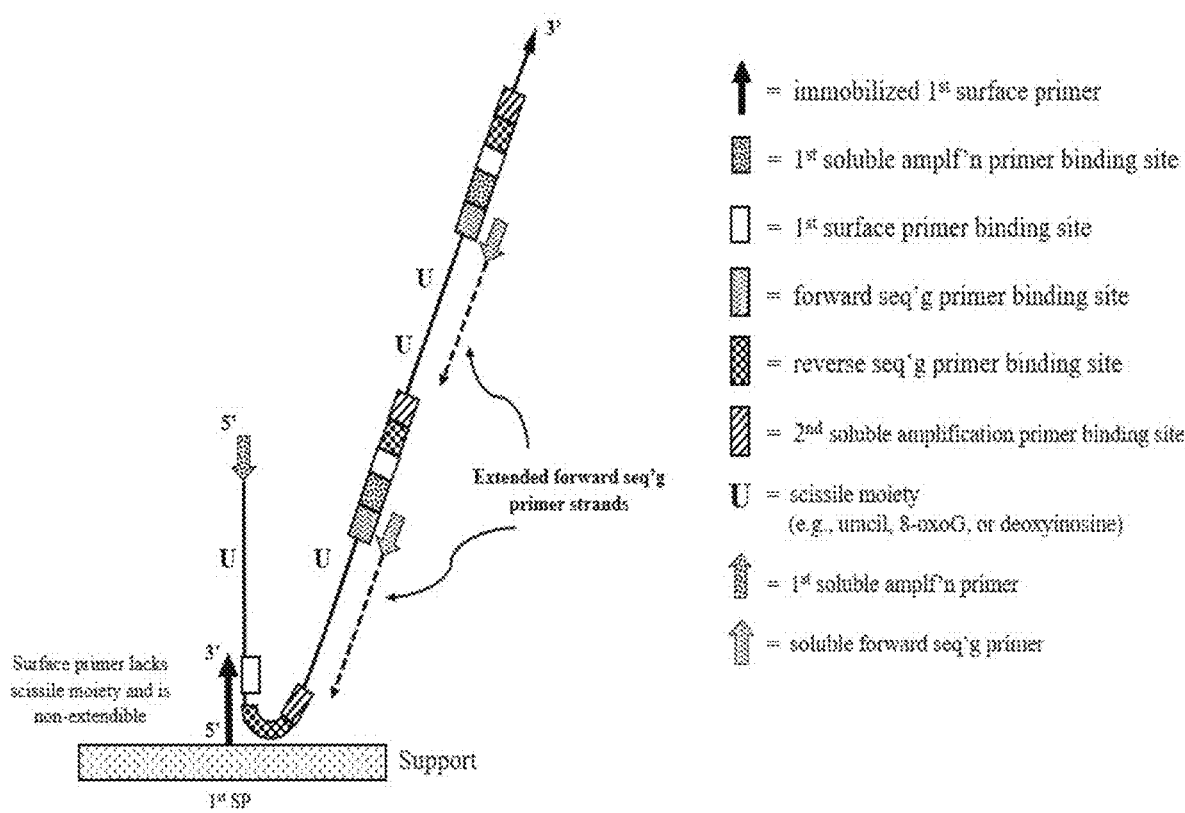
FIGS. 14-25 show the workflow of pairwise sequencing the immobilized concatemer template molecule depicted in FIG. 13.

In some embodiments, the pairwise sequencing method further comprises step (b): sequencing the plurality of immobilized concatemer template molecules thereby generating a plurality of extended forward sequencing primer strands. The sequencing of step (b) comprises contacting the plurality of immobilized concatemer template molecules with a plurality of soluble forward sequencing primers under a condition suitable to hybridize at least one forward sequencing primer to at least one of the forward sequencing primer binding sites/sequences of the immobilized concatemer template molecules, and conducting forward sequencing reactions using one or more types of sequencing polymerases, a plurality of nucleotides and/or multivalent molecules, and the hybridized first forward sequencing primers. The forward sequencing reactions can generate a plurality of extended forward sequencing primer strands. In some embodiments, individual immobilized concatemer template molecules have multiple copies of the forward sequencing primer binding sites, wherein each forward sequencing primer binding site is capable of hybridizing to a first forward sequencing primer. Individual forward sequencing primer binding sites in a given immobilized concatemer template molecule can be hybridized to a forward sequencing primer and can undergo a sequencing reaction. Individual immobilized concatemer template molecules can undergo two or more sequence reactions, where each sequencing reaction is initiated from a first forward sequencing primer that is hybridized to a forward sequencing primer binding site (e.g., see FIGS. 2 and 14). In some embodiments, the soluble forward sequencing primers comprise 3' OH extendible ends. In some embodiments, the soluble forward sequencing primers comprise a 3' blocking moiety which can be removed to generate a 3' OH extendible end. In some embodiments, the soluble forward sequencing primers lack a nucleotide having a scissile moiety. In some embodiments, the sequencing reactions comprise a plurality of nucleotides (or analogs thereof) labeled with a detectable reporter moiety. In some embodiments, the sequencing reaction comprise a plurality of multivalent molecules having a plurality of nucleotide units attached to a core, where the multivalent molecules are labeled with a detectable reporter moiety. In some embodiments, the core is labeled with a detectable reporter moiety. In some embodiments, at least one linker and/or at least one nucleotide unit of a nucleotide arm is labeled with a detectable reporter moiety. In some embodiments, the detectable reporter moiety comprises a fluorophore. An exemplary nucleotide arm is shown in FIG. 108, and exemplary multivalent molecules are shown in FIGS. 104-107.

In some embodiments, the sequencing polymerases of step (b) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (b) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

In some embodiments, the pairwise sequencing method further comprises step (c): retaining the plurality of immobilized concatemer template molecules and replacing the plurality of extended forward sequencing primer strands with a plurality of forward extension strands that are hybridized to the retained immobilized single stranded nucleic acid concatemer template molecules. The plurality of extended forward sequencing primer strands can be removed and replaced with a plurality of forward extension strands by conducting a primer extension reaction (see FIGS. 3-5, and FIGS. 15-17).

Figure 3:
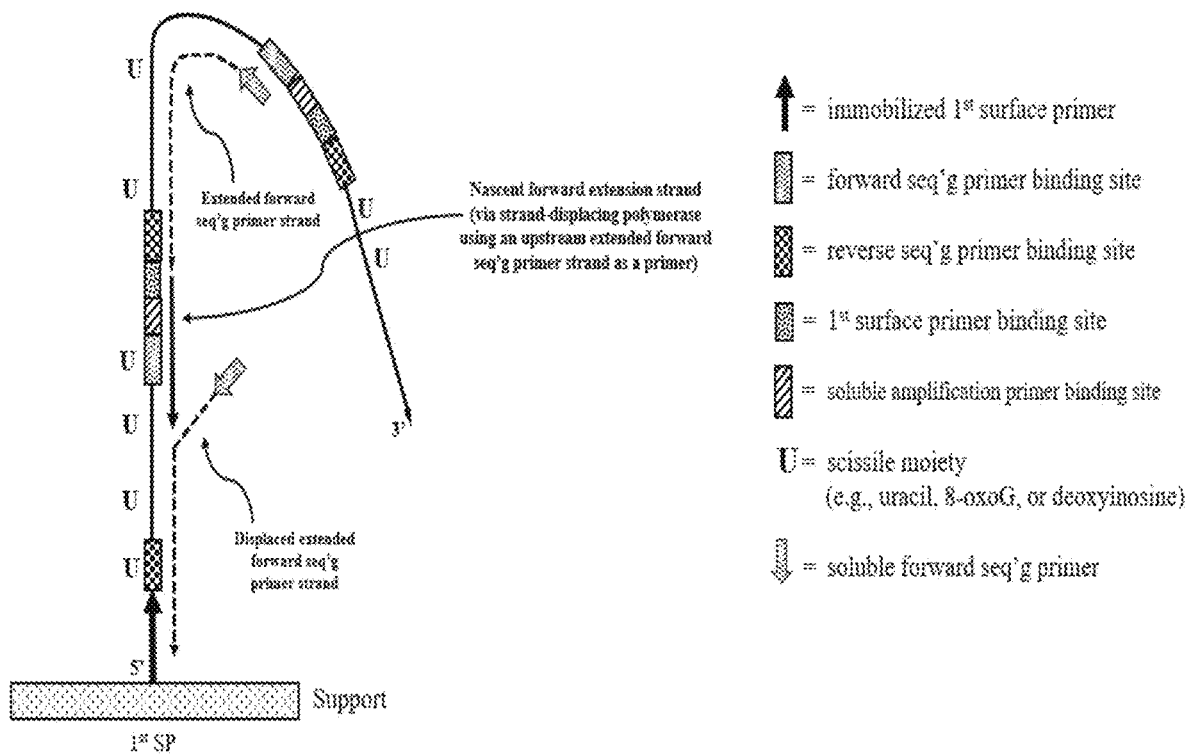
Figure 15:
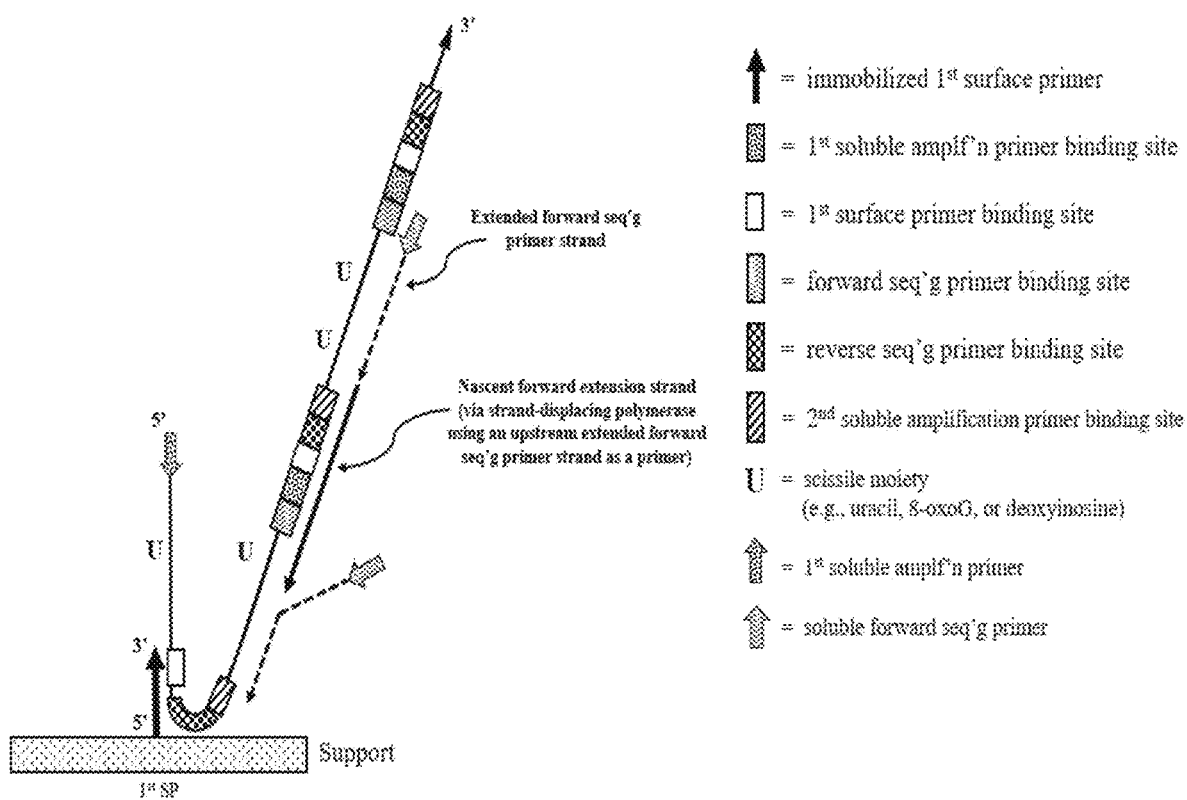

In some embodiments, step (c) comprises contacting at least one extended forward sequencing primer strand with a plurality of strand displacing polymerases and a plurality of nucleotides and in the absence of soluble amplification primers, under a condition suitable to conduct a strand displacing primer extension reaction using the at least one extended forward sequencing primers strand to initiate the primer extension reaction thereby generating a forward extension strand that is covalently joined to the extended forward sequencing primers strand, wherein the forward extension strand is hybridized to the immobilized concatemer template molecule. For example, one of the extended forward sequencing primer strands can serve as a primer for the strand displacing polymerase. The strand displacing polymerase can extend the extended forward sequencing primer strand, and displace downstream extended forward sequencing primer strands while synthesizing an extended strand that replaces the downstream extended forward sequencing primer strands (FIGS. 3 and 15). The newly extended strand is covalently joined to an extended forward sequencing primer strand. The immobilized concatemer template molecules are retained.

The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine III). Inclusion of compaction oligonucleotides and/or hexamine (e.g., cobalt hexamine III) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 μm or smaller.

Examples of strand displacing polymerases include phi29 DNA polymerase, large fragment of Bst DNA polymerase, large fragment of Bsu DNA polymerase (exo-), Bca DNA polymerase (exo-), Klenow fragment of *E. coli* DNA polymerase, T5 polymerase, M-MuLV reverse transcriptase, HIV viral reverse transcriptase, Deep Vent® DNA polymerase and KOD DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio).

Figure 4:
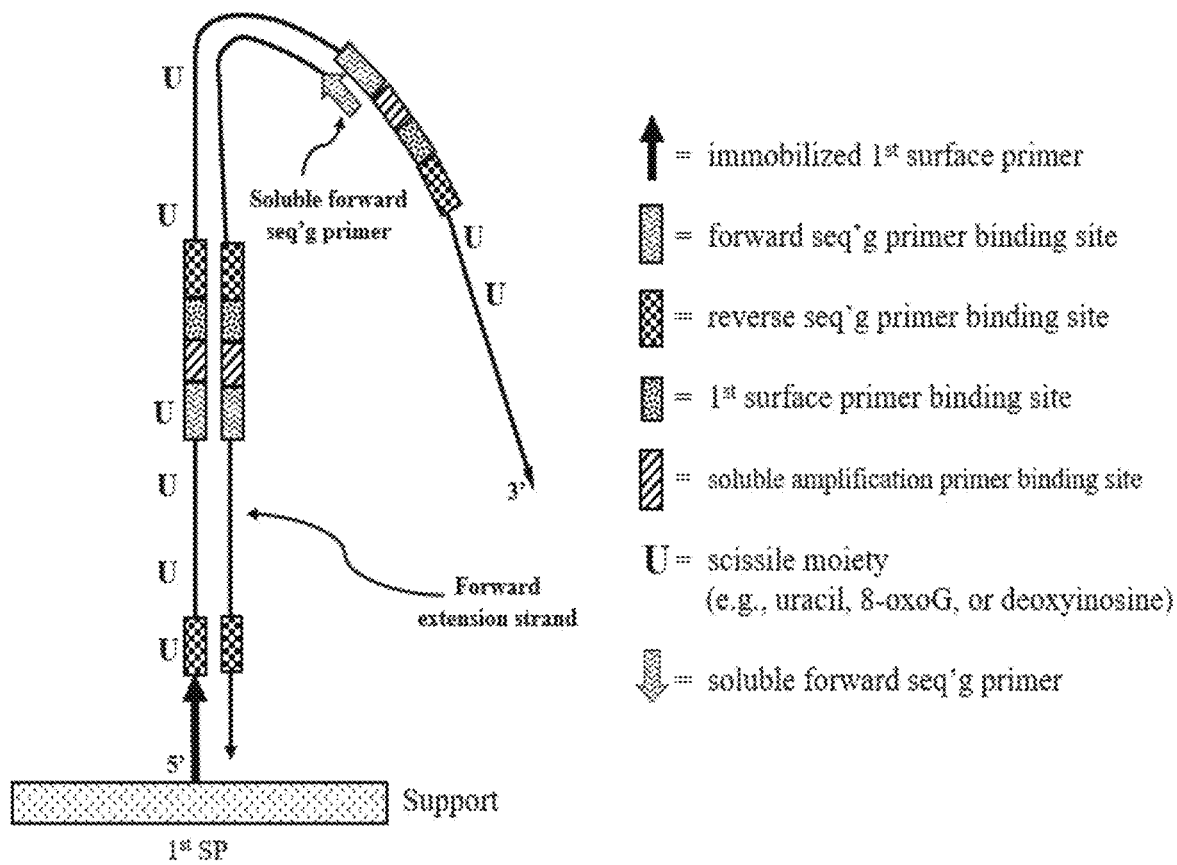
Figure 16:
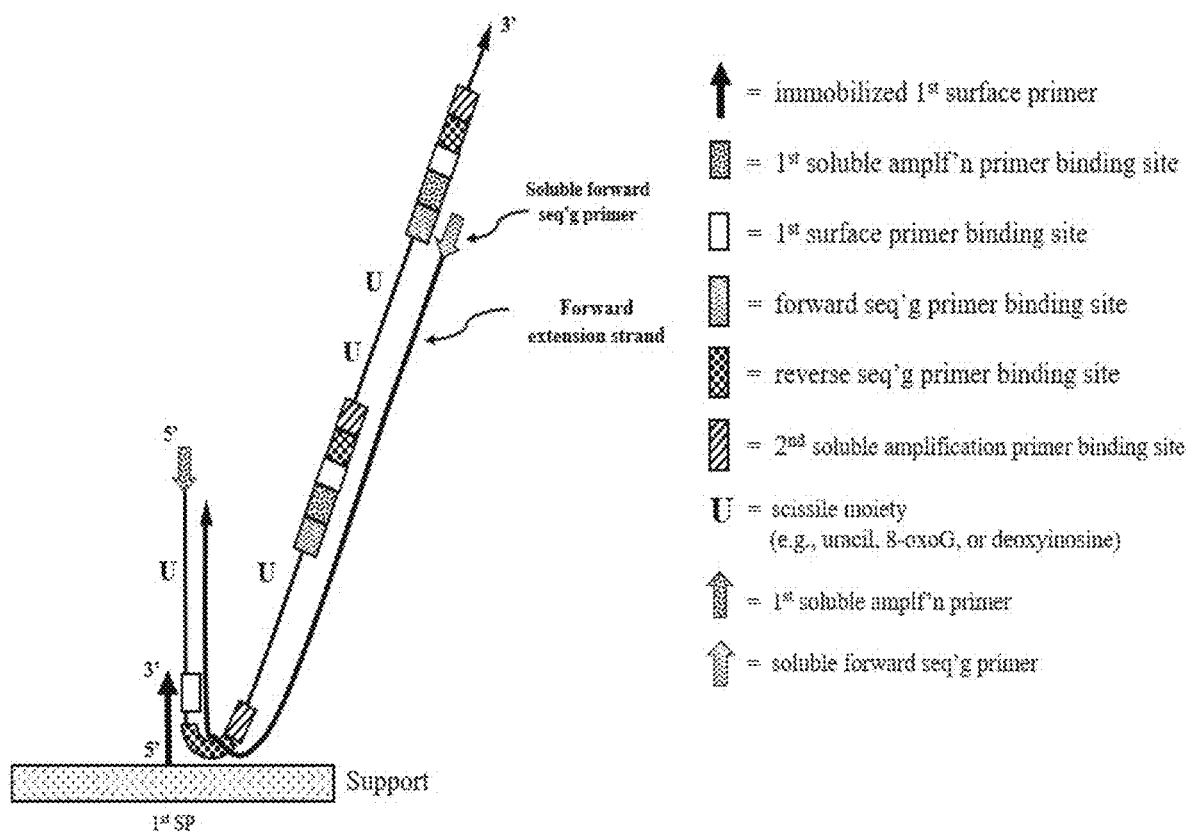

In some embodiments, step (c) comprises: (i) removing the plurality of extended forward sequencing primer strand while retaining the immobilized concatemer template molecules; and (ii) contacting the plurality of retained immobilized concatemer molecules with a plurality of soluble forward sequencing primers (e.g., a second plurality of soluble forward sequencing primers), a plurality of nucleotides (e.g., a second plurality of nucleotides) and a plurality of primer extension polymerases, under a condition suitable to hybridize the plurality of soluble forward sequencing primers to the plurality of retained immobilized concatemer template molecules and suitable for conducting polymerase-catalyzed primer extension reactions thereby generating a plurality of forward extension strands, wherein the soluble sequencing primers hybridize with the forward sequencing primer binding sequence in the retained immobilized concatemer molecules (FIGS. 4 and 16). The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine III). Inclusion of compaction oligonucleotides and/or hexamine (e.g., cobalt hexamine III) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 μm or smaller.

In some embodiments, in step (c), the condition suitable to hybridize the plurality of soluble forward sequencing primers to the plurality of retained immobilized single stranded nucleic acid concatemer template molecules comprises hybridizing retained immobilized concatemer template molecules with the soluble primers in the presence of a primer extension polymerase, a plurality of nucleotides, and a high efficiency hybridization buffer. In some embodiment, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

Figure 5:
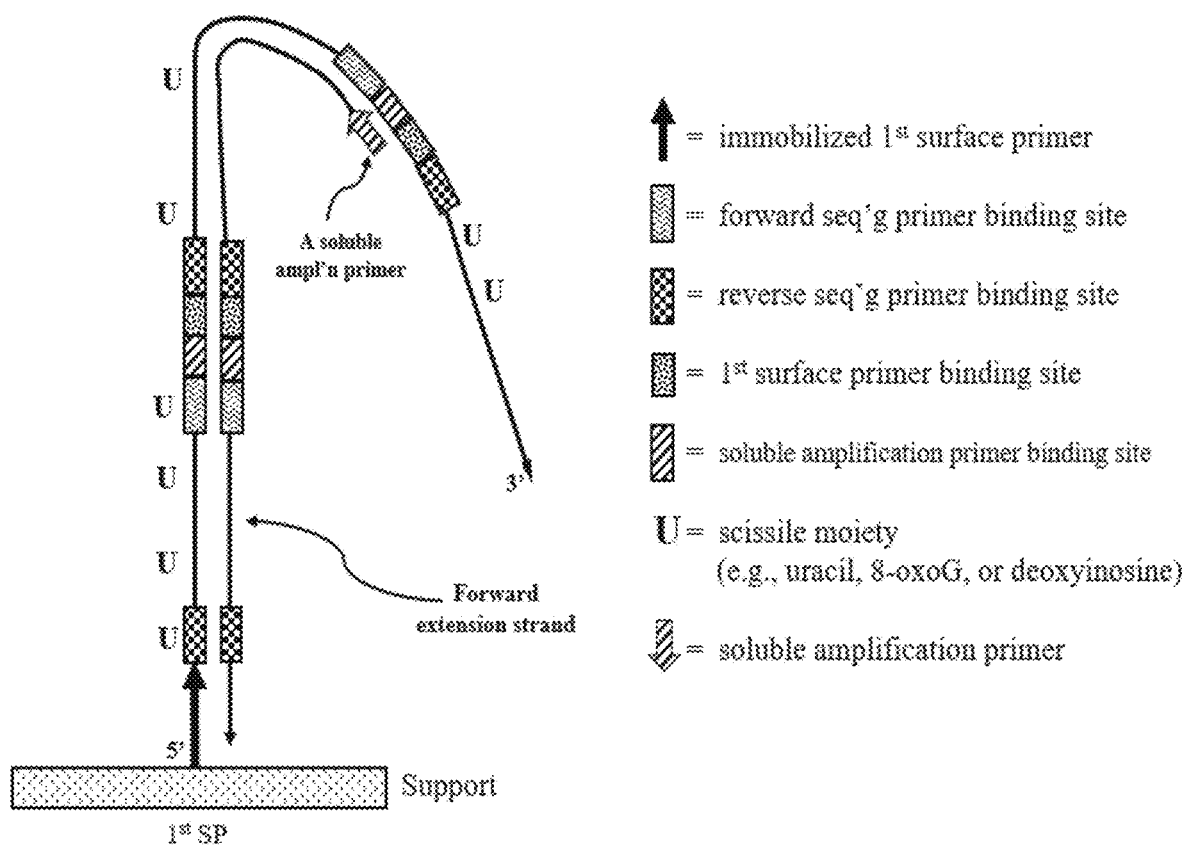
Figure 17:
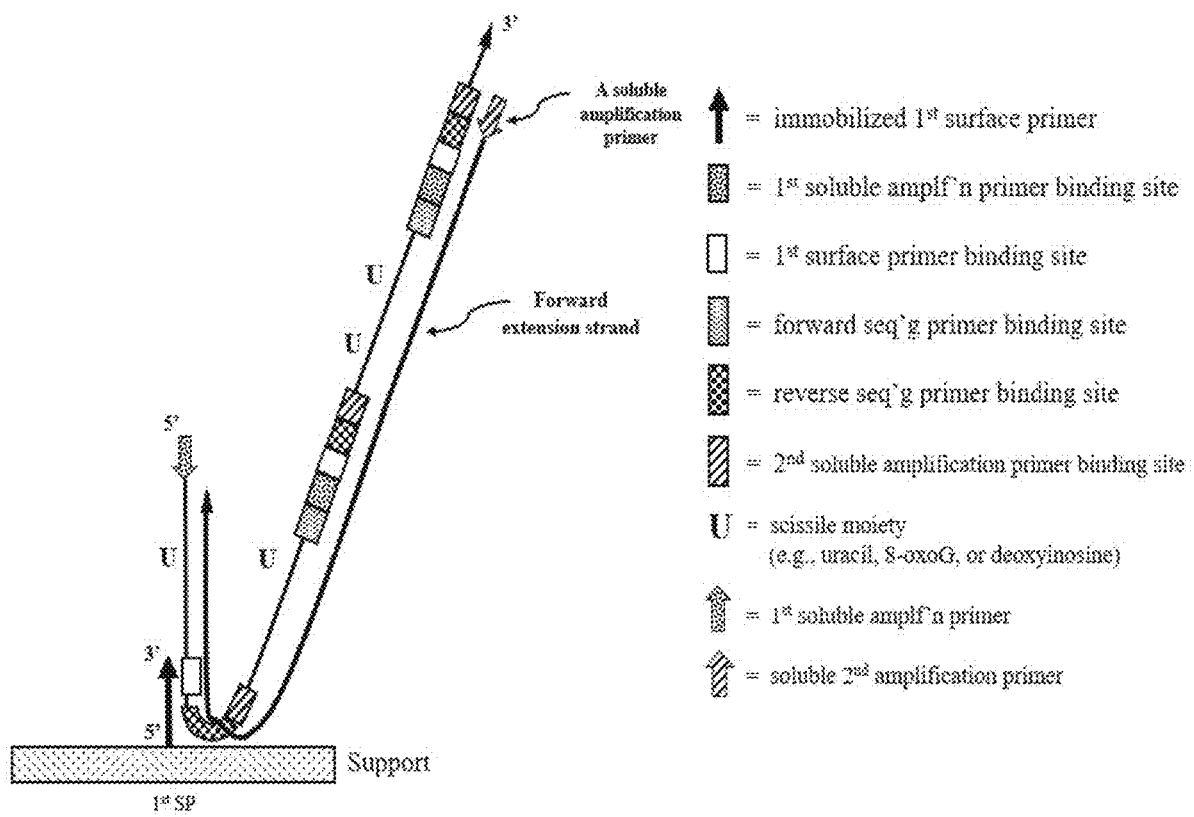

In some embodiments, step (c) comprises: (i) removing the plurality of extended forward sequencing primer strand while retaining the immobilized concatemer template molecules; and (ii) contacting the plurality of retained immobilized concatemer molecules with a plurality of soluble amplification primers, a plurality of nucleotides (e.g., a second plurality of nucleotides) and a plurality of primer extension polymerases, under a condition suitable to hybridize the plurality of soluble amplification primers to the plurality of retained immobilized concatemer template molecules and suitable for conducting polymerase-catalyzed primer extension reactions thereby generating a plurality of forward extension strands, wherein the soluble amplification primers hybridize with the soluble amplification primer binding sequence in the retained immobilized concatemer molecules (FIGS. 5 and 17). The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine III). Inclusion of compaction oligonucleotides and/or hexamine (e.g., cobalt hexamine III) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 µm or smaller.

In some embodiments, in step (c), the condition suitable to hybridize the plurality of soluble amplification primers to the plurality of retained immobilized single stranded nucleic acid concatemer template molecules comprises hybridizing retained immobilized concatemer template molecules with the soluble primers in the presence of a primer extension polymerase, a plurality of nucleotides, and a high efficiency hybridization buffer. In some embodiment, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, in step (c), the plurality of extended forward sequencing primer strands can be removed using an enzyme or a chemical reagent. For example, the plurality of extended forward sequencing primer strands can be enzymatically degraded using a 5' to 3' double-stranded DNA exonuclease, including T7 exonuclease (e.g., from New England Biolabs, catalog #M0263S). In some embodiments, the plurality of extended forward sequencing primer strands can be removed with a temperature that favors nucleic acid denaturation.

In some embodiments, in step (c), a denaturation reagent can be used to remove the plurality of extended forward sequencing primer strands, wherein the denaturation reagent comprises any one or any combination of compounds such as formamide, acetonitrile, guanidinium chloride and/or a pH buffering agent (e.g., Tris-HCl, MES, HEPES, MOPS, or the like). Optionally, the denaturation reagent can further comprise PEG.

In some embodiments, in step (c), the plurality of extended forward sequencing primer strands can be removed using an elevated temperature (e.g., heat) with or without a nucleic acid denaturation reagent. The plurality of extended forward sequencing primer strands can be subjected to a temperature of about 45-50° C., or about 50-60° C., or about 60-70° C., or about 70-80° C., or about 80-90° C., or about 90-95° C., or higher temperature.

In some embodiments, in step (c), the plurality of extended forward sequencing primer strands can be removed using 100% formamide at a temperature of about 65° C. for about 3 minutes, and washing with a reagent comprising about 50 mM NaCl or equivalent ionic strength and having a pH of about 6.5-8.5.

In some embodiments, the primer extension polymerase of step (c) comprises a high fidelity polymerase. In some embodiments, the primer extension polymerase of step (c) comprises a DNA polymerase capable of catalyzing a primer extension reaction using a uracil-containing template molecule (e.g., a uracil-tolerant polymerase). Exemplary polymerases include, but are not limited to, Q5U® Hot Start t high-fidelity DNA polymerase (e.g., catalog #M0515S from New England Biolabs), Taq DNA polymerase, OneTaq® DNA polymerase (e.g., mixture of Taq and Deep Vent® DNA polymerases, catalog #M0480S from New England Biolabs), LongAmp® Taq DNA polymerase (e.g., catalog #M0323S from New England Biolabs), EpiMark® Hot Start Taq DNA polymerase (e.g., catalog #M0490S from New England Biolabs), Bst DNA polymerase (e.g., large fragment, catalog #M0275S from New England Biolabs), Bsu DNA polymerase (e.g., large fragment, catalog #M0330S from New England Biolabs), Phi29 DNA polymerase (e.g., catalog #M0269S from New England Biolabs), E. coli DNA polymerase (e.g., catalog #M0209S from New England Biolabs), Therminator™ DNA polymerase (e.g., catalog #M0261S from New England Biolabs), Vent® DNA polymerase and Deep Vent® DNA polymerase.

The pairwise methods described herein can provide increased accuracy in a downstream sequencing reaction because step (c) replaces the extended forward sequencing primer strands that were generated in step (b) with forward extension strands having reduced base errors. The extended forward sequencing primer strands are generated in step (b) and may or may not contain erroneously incorporated nucleotides due to polymerase-catalyzed mis-paired bases. When step (c) is conducted with a high fidelity DNA polymerase, the resulting forward extension strands may have reduced base errors compared to the extended forward sequencing primer strands. The forward extension strands will be used as a nucleic acid template for a downstream sequencing step (e.g., see step (e) below). Thus, step (c) can increase the sequencing accuracy of the downstream step (e) and therefore increase the overall sequencing accuracy of the pairwise sequencing workflow.

Figure 6:
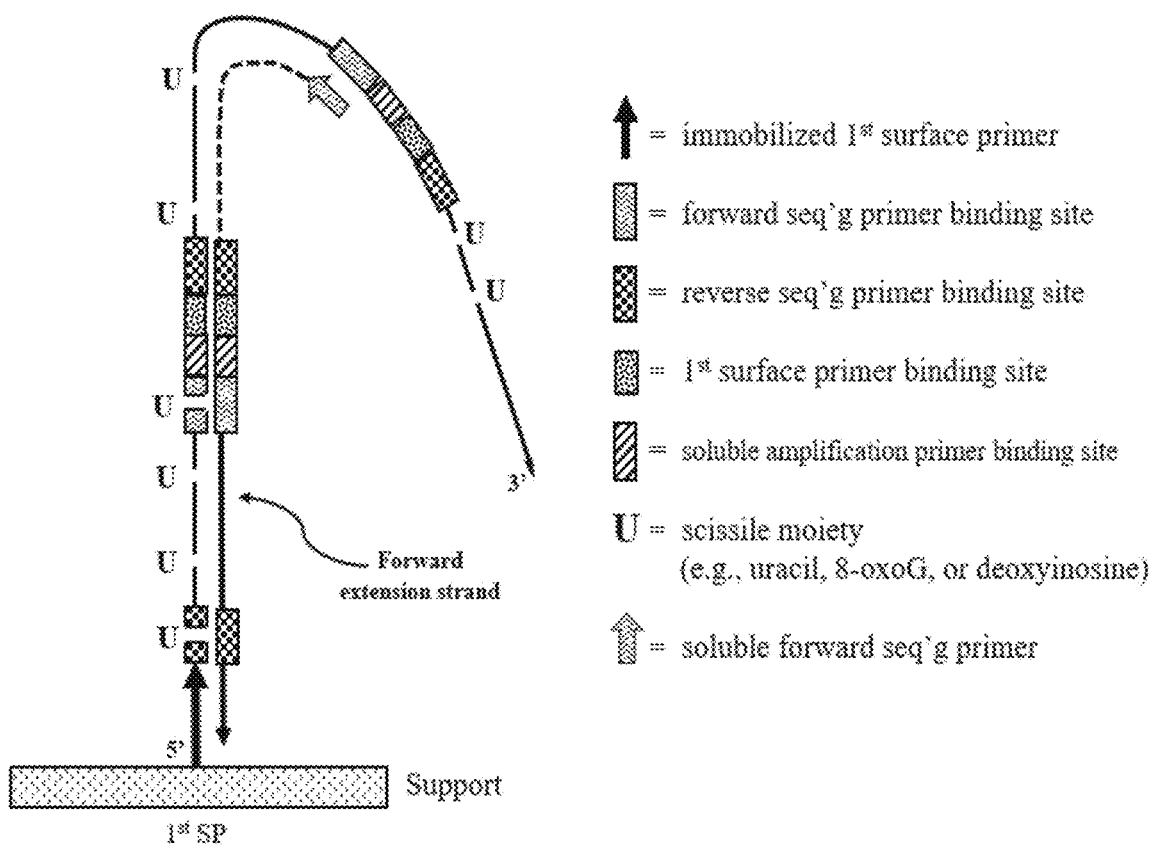
Figure 18:
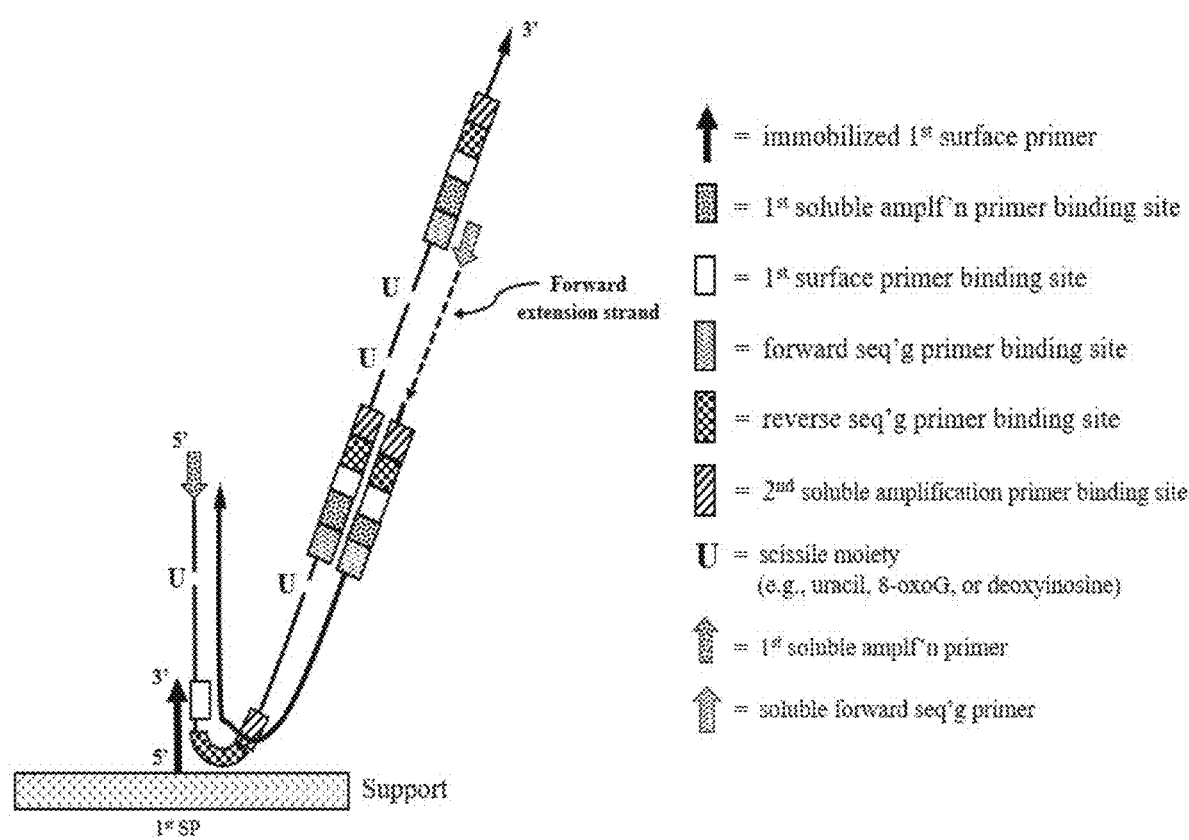
Figure 19:
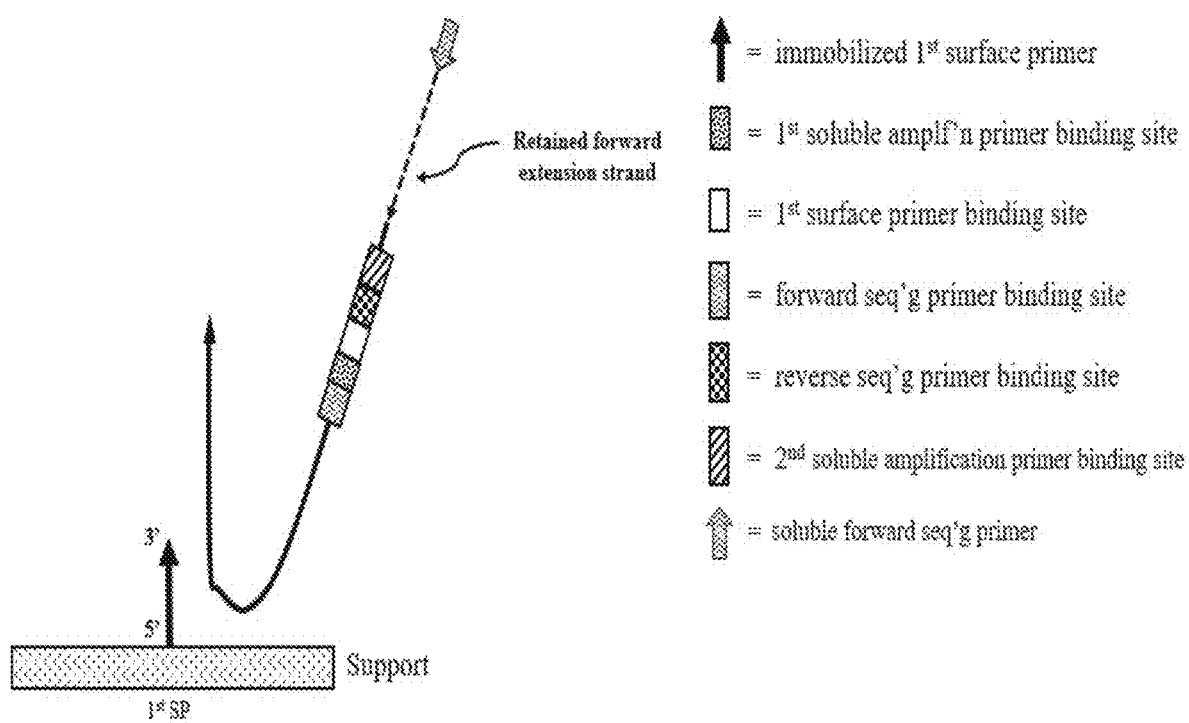
Figure 20:
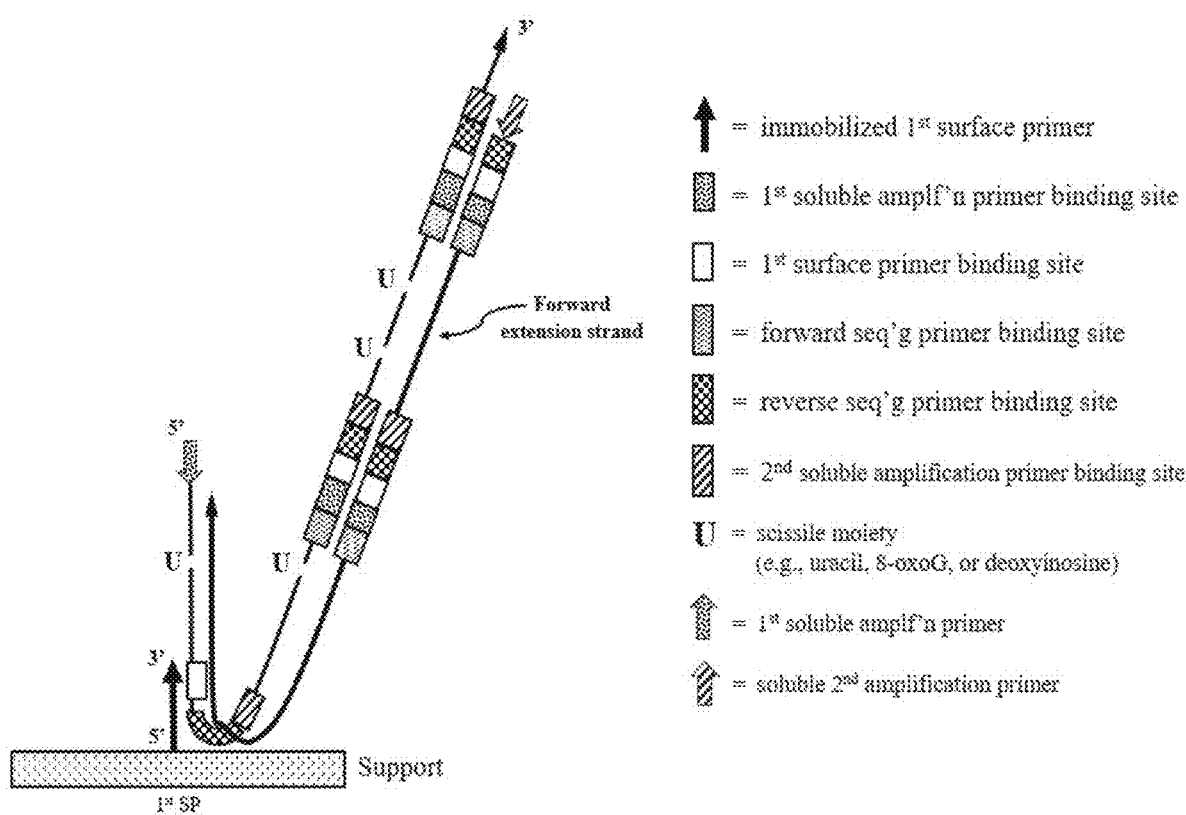
Figure 21:
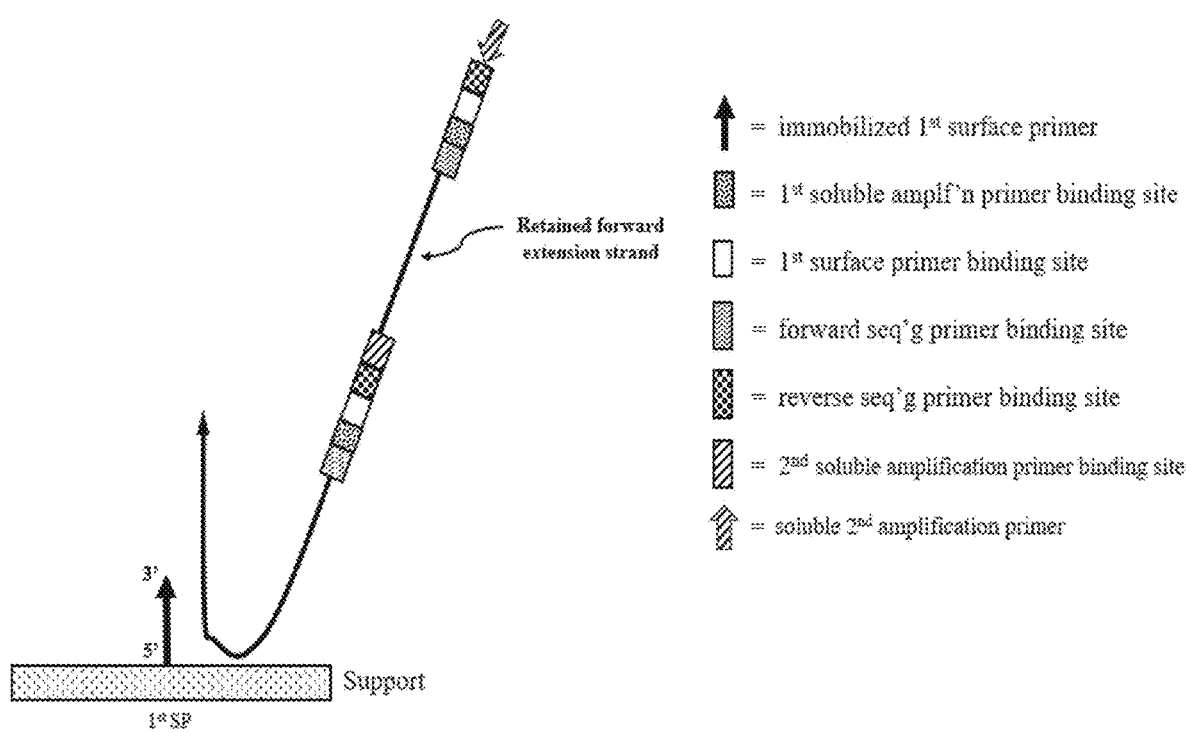
Figure 22:
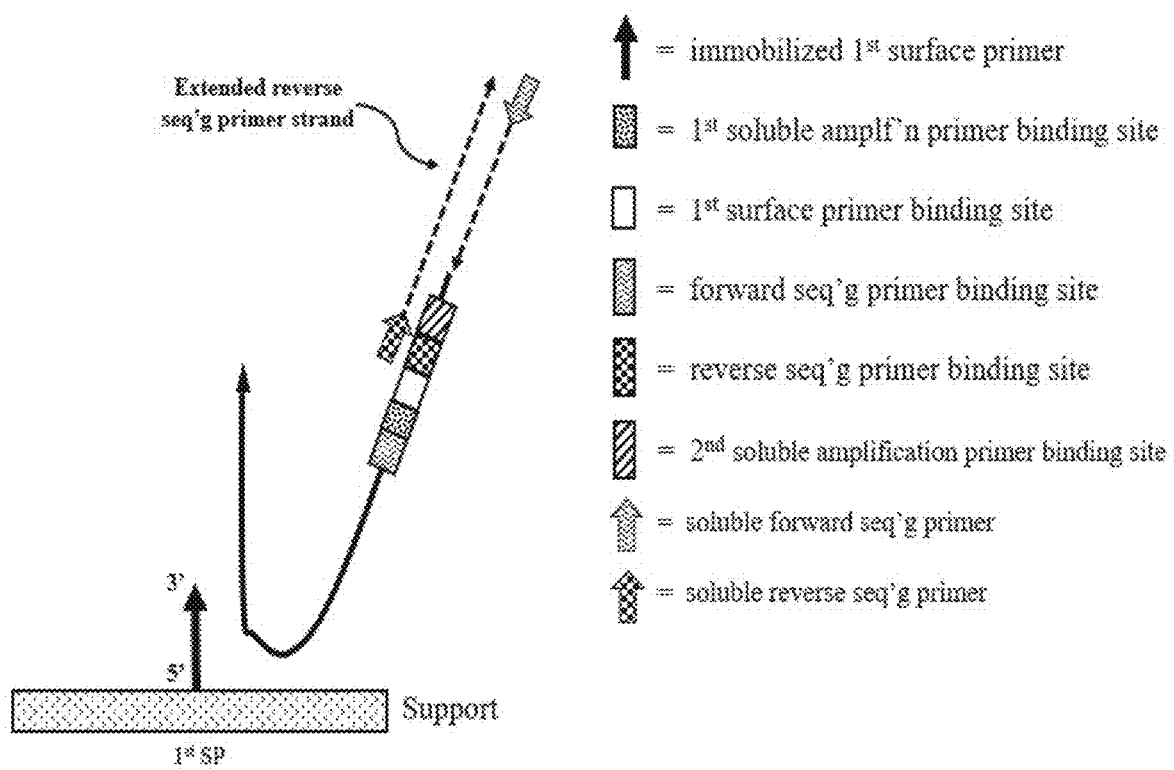
Figure 23:
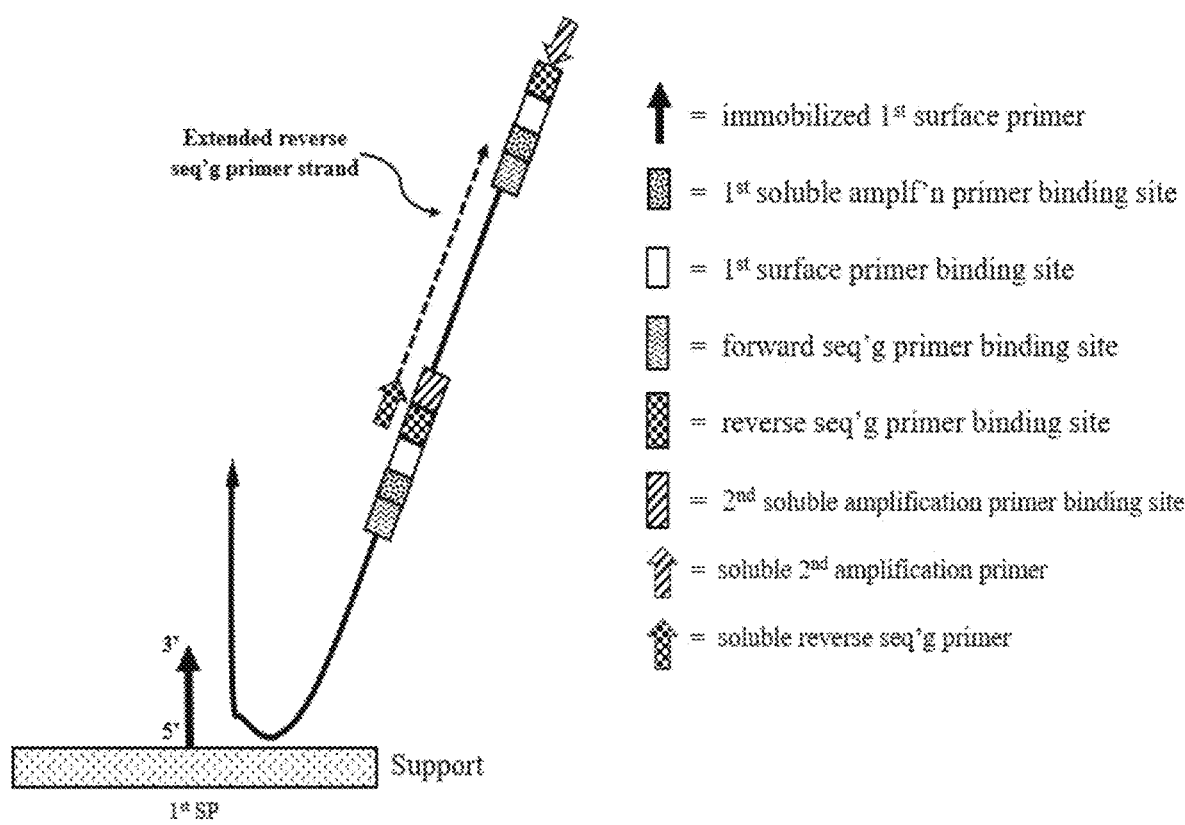

In some embodiments, the pairwise sequencing method further comprises step (d): removing the retained immobilized concatemer template molecules by generating abasic sites in the immobilized single stranded concatemer template molecules at the nucleotide(s) having the scissile moiety and generating gaps at the abasic sites to generate a plurality of gap-containing single stranded nucleic acid concatemer template molecules while retaining the plurality of forward extension strands and retaining the plurality of immobilized surface primers (FIGS. 6 and 18).

The abasic sites are generated on the retained concatemer template strands that contain nucleotides having scissile moieties. In some embodiments, the scissile moieties in the retained concatemer template molecules comprises uridine, 8-oxo-7,8-dihydroguanine (e.g., 8oxoG) or deoxyinosine. The abasic sites can be removed to generate a plurality of single stranded nucleic acid template molecules having gaps while retaining the plurality of forward extension strands. The abasic sites can be generated by contacting the immobilized concatemer template molecules with an enzyme that removes the nucleo-base at the nucleotide having the scissile moiety. The uracil in the retained concatemer template strands can be converted to an abasic site using uracil DNA glycosylase (UDG). The 8oxoG in the retained concatemer template strands can be converted to an abasic site using FPG glycosylase. The deoxyinosine in the retained concatemer template strands can be converted to an abasic site using AlkA glycosylase.

In some embodiments, in step (d), the gaps can be generated by contacting the abasic sites in the immobilized concatemer template molecules with an enzyme or a mixture of enzymes having lyase activity that breaks the phosphodiester backbone at the 5' and 3' sides of the abasic site to release the base-free deoxyribose and generate a gap (FIGS. 6 and 18). The abasic sites can be removed using AP lyase, Endo IV endonuclease, FPG glycosylase/AP lyase, Endo VIII glycosylase/AP lyase. In some embodiments, generating the abasic sites and removal of the abasic sites to generate gaps can be achieved using a mixture of uracil DNA glycosylase and DNA glycosylase-lyase endonuclease VIII, for example USER™ (Uracil-Specific Excision Reagent Enzyme from New England Biolabs) or thermolabile USER™ (also from New England Biolabs).

In some embodiments, in step (d), the plurality of gap-containing template molecules can be removed using an enzyme, chemical and/or heat. After the gap-removal procedure, the plurality of retained forward extension strands (e.g., see FIGS. 7 and 9, and FIGS. 19 and 21), is hybridized to the retained immobilized surface primers For example, the plurality of gap-containing template molecules can be enzymatically degraded using a 5' to 3' double-stranded DNA exonuclease, including T7 exonuclease (e.g., from New England Biolabs, catalog #M0263S). When a 5' to 3' double-stranded DNA exonuclease is used for removing gap-containing template molecules, then the plurality of soluble amplification primers in step (c) can comprise at least one phosphorothioate diester bond at their 5' ends which can render the soluble amplification primers resistant to exonuclease degradation. In some embodiments, the plurality of soluble amplification primers in step (c) comprise 2-5 or more consecutive phosphorothioate diester bonds at their 5' ends. In some embodiments, the plurality soluble amplification primers in step (c) comprise at least one ribonucleotide and/or at least one 2'-O-methyl or 2'-O-methoxyethyl (MOE) nucleotide which can render the forward sequencing primers resistant to exonuclease degradation.

In some embodiments, the plurality of gap-containing template molecules can be removed using a chemical reagent that favors nucleic acid denaturation. The denaturation reagent can include any one or any combination of compounds such as formamide, acetonitrile, guanidinium chloride and/or a buffering agent (e.g., Tris-HCl, MES, HEPES, or the like).

In some embodiments, the plurality of gap-containing template molecules can be removed using an elevated temperature (e.g., heat) with or without a nucleic acid denaturation reagent. The gap-containing template molecules can be subjected to a temperature of about 45-50° C., or about 50-60° C., or about 60-70° C., or about 70-80° C., or about 80-90° C., or about 90-95° C., or higher temperature.

In some embodiments, the plurality of gap-containing template molecules can be removed using 100/6 formamide at a temperature of about 65° C. for about 3 minutes, and washing with a reagent comprising about 50 mM NaCl or equivalent ionic strength and having a pH of about 6.5-8.5.

In some embodiments, the pairwise sequencing method further comprises step (e): sequencing the plurality of retained forward extension strands thereby generating a plurality of extended reverse sequencing primer strands. In some embodiments, the sequencing of step (e) comprises contacting the plurality of retained forward extension strands with a plurality of soluble reverse sequencing primers under a condition suitable to hybridize the reverse sequencing primers to the reverse sequencing primer binding site of the retained forward extension strands, and by conducting sequencing reactions using the hybridized reverse sequencing primers wherein the forward sequencing reactions generates a plurality of extended reverse sequencing primer strands (FIGS. 10 and 11, and FIGS. 22 and 23). The extended reverse sequencing primer strands are hybridized to the retained forward extension strand. The retained forward extension strand is hybridized to the first surface primer. The extended reverse sequencing primer strands are not hybridized to the first surface primer, or covalently joined to the first surface primer. Therefore, the extended reverse sequencing primer strands are not immobilized to the support.

Figure 7:
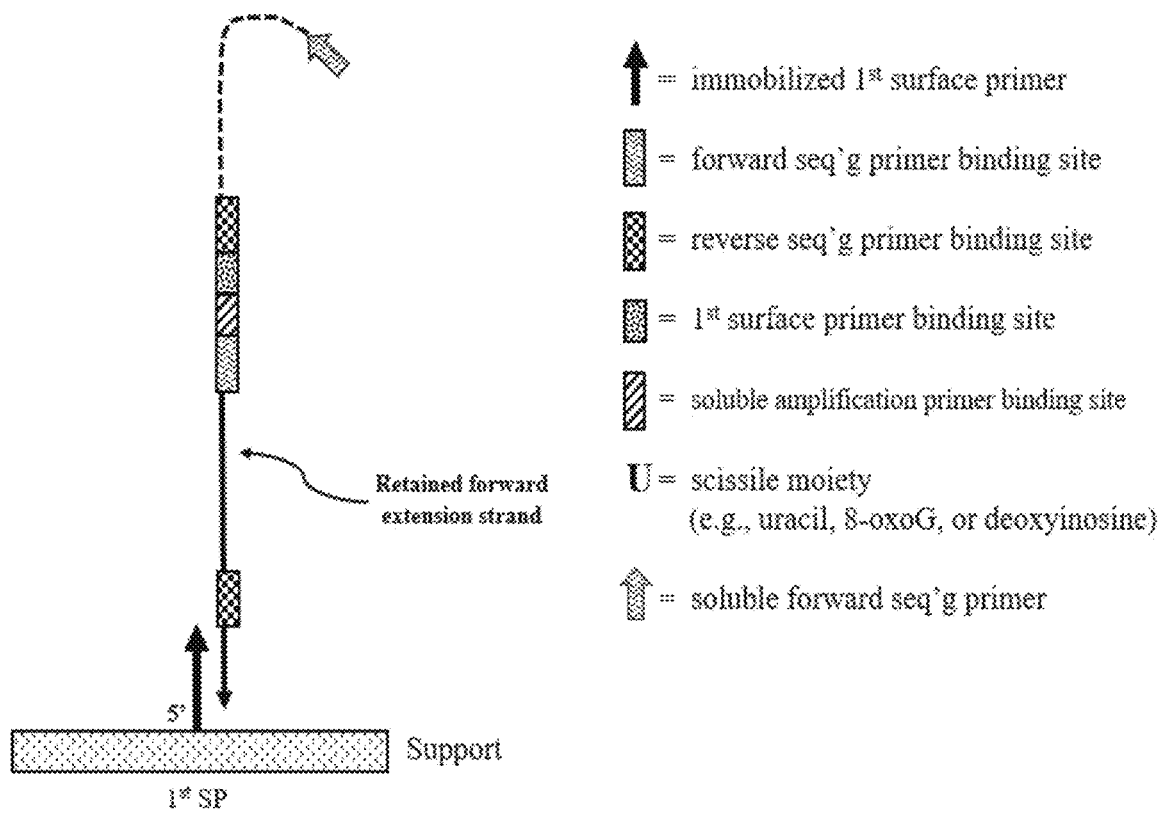
Figure 8:
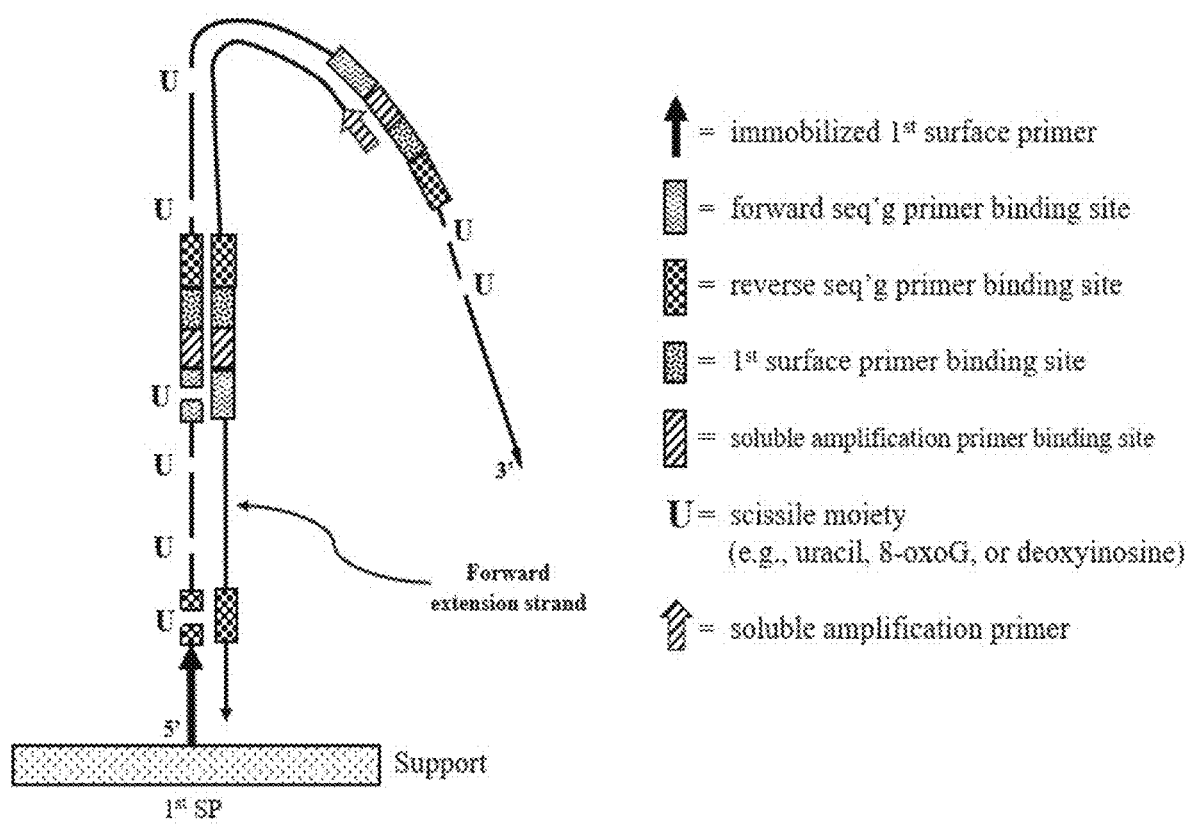
Figure 9:
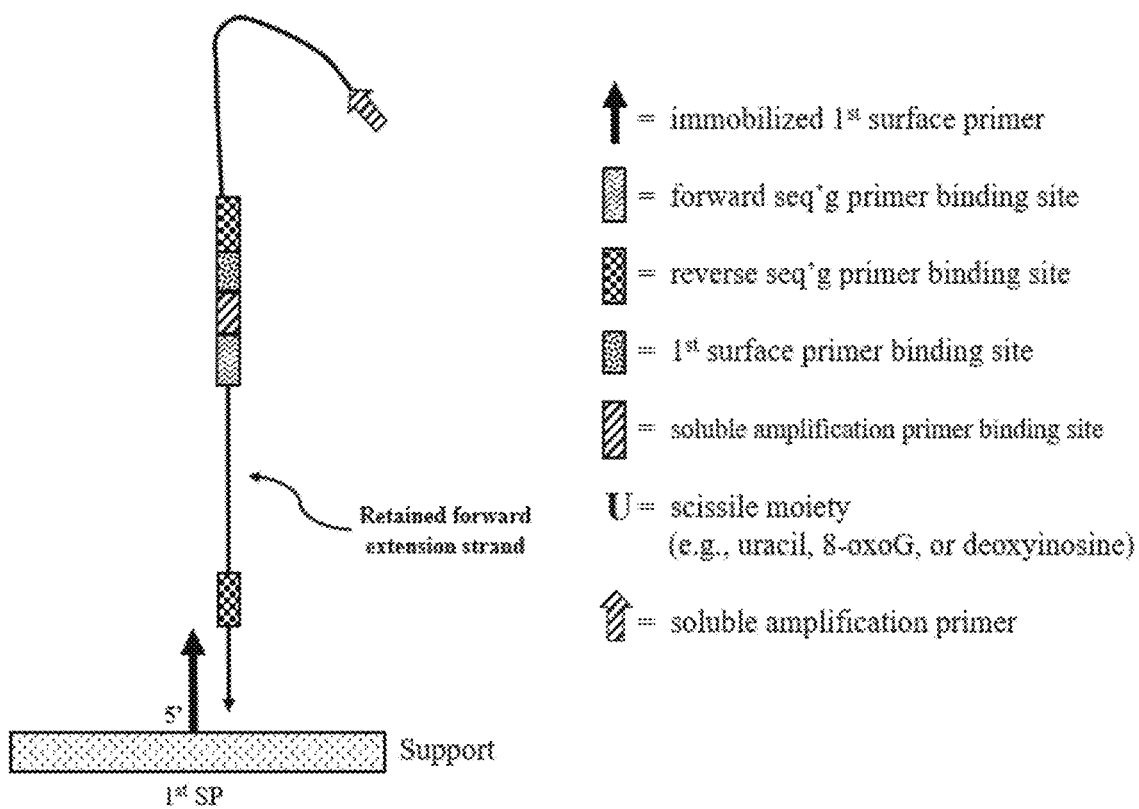
Figure 10:
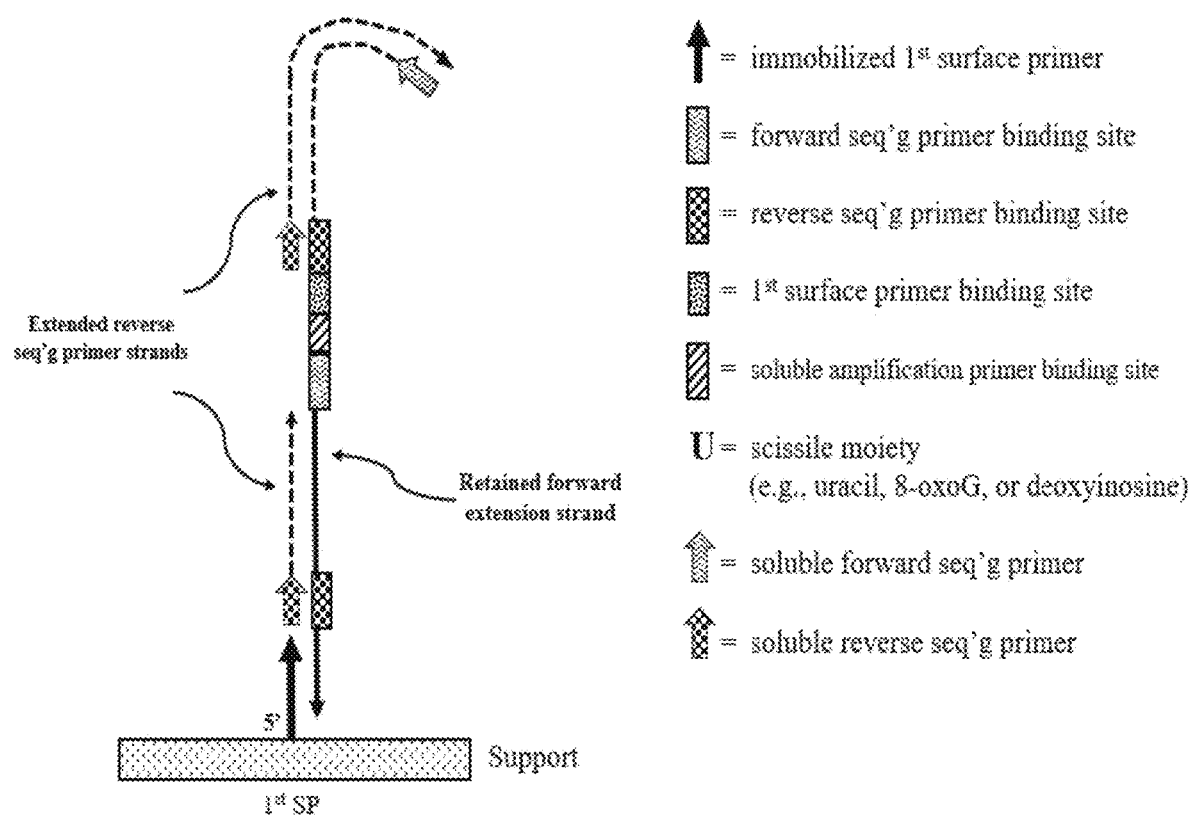
Figure 11:
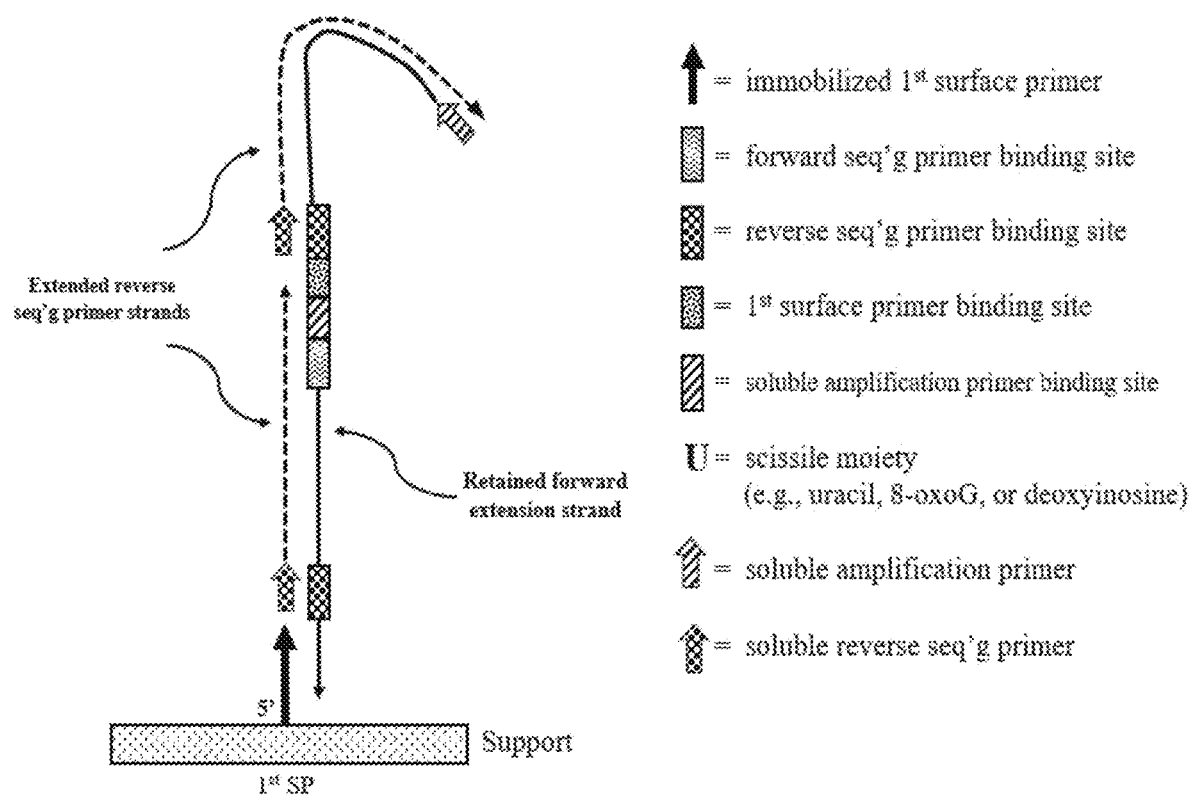

For the sake of simplicity, FIGS. 7 and 9 show exemplary retained forward extension strands each having one copy of the sequence of interest and various universal primer binding sites. The skilled artisan will appreciate that the retained forward extension strand can include two or more tandem copies containing the sequence of interest and various universal primer binding sites. Therefore, the reverse sequencing reaction can generate a plurality of extended reverse sequencing primer strands hybridized to the same retained forward extension strand.

In some embodiments, in step (e), the condition suitable to hybridize the reverse sequencing primers to the reverse sequencing primer binding sequences of the retained forward extension strands comprises contacting the plurality of soluble reverse sequencing primers and the retained forward extension strands with a high efficiency hybridization buffer. In some embodiments, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10/a by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In an alternative embodiment, the sequencing of step (e) comprises using the immobilized surface primer as a sequencing primer and conducting sequencing reactions to generate a plurality of reverse sequencing strands.

In some embodiments, the reverse sequencing reactions of step (e) comprises contacting the plurality of soluble reverse sequencing primers with the reverse sequencing primer binding sequences of the retained forward extension strands, one or more types of sequencing polymerases, and a plurality of nucleotides or a plurality of multivalent molecules. In some embodiments, the soluble reverse sequencing primers comprise 3' OH extendible ends. In some embodiments, the soluble reverse sequencing primers comprise a 3' blocking moiety which can be removed to generate a 3' OH extendible end. In some embodiments, the soluble reverse sequencing primers lack a nucleotide having a scissile moiety. The sequencing reactions that employ nucleotides and/or multivalent molecules is described in more detail below. The reverse sequencing reactions can generate a plurality of extended reverse sequencing primer strands. In some embodiments, individual retained forward extension strands have multiple copies of the reverse sequencing primer binding sequences/sites, wherein each reverse sequencing primer binding site is capable of hybridizing to a reverse sequencing primer. Individual reverse sequencing primer binding sites in a given retained forward extension strand can be hybridized to a reverse sequencing primer and can undergo a sequencing reaction. Thus, an individual retained forward extension strand can undergo two or more sequence reactions, where each sequencing reaction is initiated from a reverse sequencing primer that is hybridized to a reverse sequencing primer binding site (e.g., see FIGS. 10 and 11, and FIGS. 22 and 23). In some embodiments, the sequencing reactions comprise a plurality of nucleotides (or analogs thereof) labeled with a detectable reporter moiety. In some embodiments, the sequencing reaction comprise a plurality of multivalent molecules having nucleotide units, where the multivalent molecules are labeled with a detectable reporter moiety. In some embodiments, the detectable reporter moiety comprises a fluorophore.

In some embodiments, the sequencing polymerases of step (e) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (e) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

In some embodiments, at least one washing step can be conducted after any of steps (a)-(e). The washing step can be conducted with a wash buffer comprising a pH buffering agent, a metal chelating agent, a salt, and a detergent.

In some embodiments, the pH buffering compound in the wash buffer comprises any one or any combination of two or more of Tris, Tris-HCl, Tricine, Bicine, Bis-Tris propane, HEPES, MES, MOPS, MOPSO, BES, TES, CAPS, TAPS, TAPSO, ACES, PIPES, ethanolamine (a.k.a 2-amino methanol; MEA), a citrate compound, a citrate mixture, NaOH and/or KOH. In some embodiments, the pH buffering agent can be present in the wash buffer at a concentration of about 1-100 mM, or about 10-50 mM, or about 10-25 mM. In some embodiments, the pH of the pH buffering agent which is present in any of the reagents described here in can be adjusted to a pH of about 4-9, or a pH of about 5-9, or a pH of about 5-8.

In some embodiments, the metal chelating agent in the wash buffer comprises EDTA (ethylenediaminetetraacetic acid), EGTA (ethylene glycol tetraacetic acid), HEDTA (hydroxyethylethylenediaminetriacetic acid), DPTA (diethylene triamine pentaacetic acid), NTA (N,N-bis(carboxymethyl)glycine), citrate anhydrous, sodium citrate, calcium citrate, ammonium citrate, ammonium bicitrate, citric acid, potassium citrate, or magnesium citrate. In some embodiments, the wash buffer comprises a chelating agent at a concentration of about 0.01-50 mM, or about 0.1-20 mM, or about 0.2-10 mM.

In some embodiments, the salt in the wash buffer comprises NaCl, KCl, $NH_2SO_4$ or potassium glutamate. In some embodiments, the detergent comprises an ionic detergent such as SDS (sodium dodecyl sulfate). The wash buffer can include a monovalent salt at a concentration of about 25-500 mM, or about 50-250 mM, or about 100-200 mM.

In some embodiments, the detergent in the wash buffer comprises a non-ionic detergent such as Triton X-100, Tween 20, Tween 80 or Nonidet P-40. In some embodiments, the detergent comprises a zwitterionic detergent such as CHAPS (3-[(3-cholamidopropyl)dimethylammonio]-1-propanesulfonate) or N-Dodecyl-N,N-dimethyl-3-amonio-1-propanesulfate (DetX). In some embodiments, the detergent comprises LDS (lithium dodecyl sulfate), sodium taurodeoxycholate, sodium taurocholate, sodium glycocholate, sodium deoxycholate or sodium cholate. In some embodiments, the detergent is included in the wash buffer at a concentration of about 0.01-0.05%, or about 0.05-0.1%, or about 0.1-0.15%, or about 0.15-0.2%, or about 0.2-0.25%.

On Support RCA and Pairwise Sequencing—Generating Abasic Sites

Figure 25:
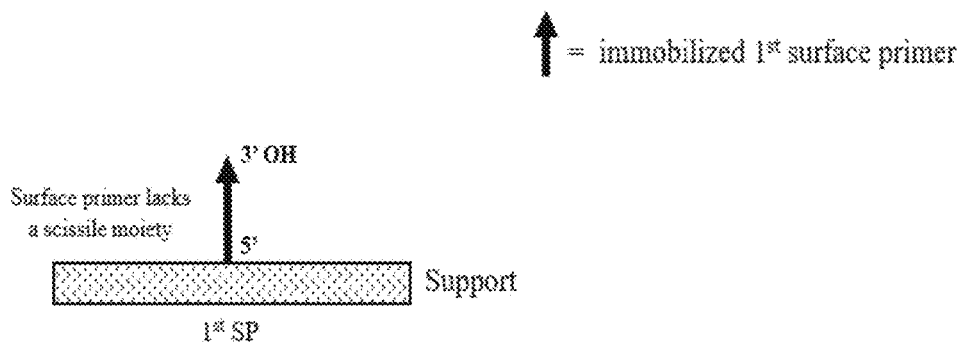

The present disclosure provides pairwise sequencing methods, comprising step (a): providing a support having a plurality of surface primers (e.g., a plurality of first surface primers) immobilized thereon wherein each of the surface primers have a 3' OH extendible end and lack a nucleotide having a scissile moiety (FIG. 25). For example, the surface primers lack uridine, 8-oxo-7,8-dihydroguanine (e.g., 8oxoG) and deoxyinosine. In some embodiments, the support comprises a plurality of first surface primers. In some embodiments, the support lacks a plurality of second surface primers. In some embodiments, the support comprises a plurality of first and second surface primers.

In some embodiments, the immobilized first surface primers comprise single stranded oligonucleotides comprising DNA, RNA or a combination of DNA and RNA. The first surface primers comprise a sequence that is wholly complementary or partially complementary along their lengths to at least a portion of a nucleic acid library molecule (e.g., linear or circular library molecules). The first surface primers can include a terminal 3' nucleotide having a sugar 3' OH moiety which is extendible for nucleotide polymerization (e.g., polymerase catalyzed polymerization).

The immobilized first surface primers can be immobilized to the support or immobilized to a coating on the support. The immobilized first surface primers can be embedded and attached (coupled) to the coating on the support. In some embodiments, the 5' end of the immobilized first surface primers are immobilized to a support or immobilized to a coating on the support. Alternatively, an interior portion or the 3' end of the immobilized first surface primers can be immobilized to a support or immobilized to a coating on the support. The support comprises a plurality of immobilized first surface primers having the same sequence. The immobilized first surface primers can be any length, for example 4-50 nucleotides, or 50-100 nucleotides, or 100-150 nucleotides, or longer lengths.

In some embodiments, the plurality of immobilized first surface primers comprise at least one phosphorothioate diester bond at their 5' ends which can render the first surface primers resistant to exonuclease degradation. In some embodiments, the plurality of immobilized first surface primers comprise 2-5 or more consecutive phosphorothioate diester bonds at their 5' ends. In some embodiments, the plurality of immobilized first surface primers comprise at least one ribonucleotide and/or at least one 2'-O-methyl or 2'-O-methoxyethyl (MOE) nucleotide which can render the first surface primers resistant to exonuclease degradation.

In some embodiments, the immobilized first surface primers comprise at least one locked nucleic acid (LNA) which comprises a methylene bridge bond between a 2' oxygen and 4' carbon of the pentose ring. Immobilized first surface primers that include at least one LNA can be resistant to nuclease digestions and can exhibit increased melting temperature when hybridized to the forward extension strand.

Figure 37:
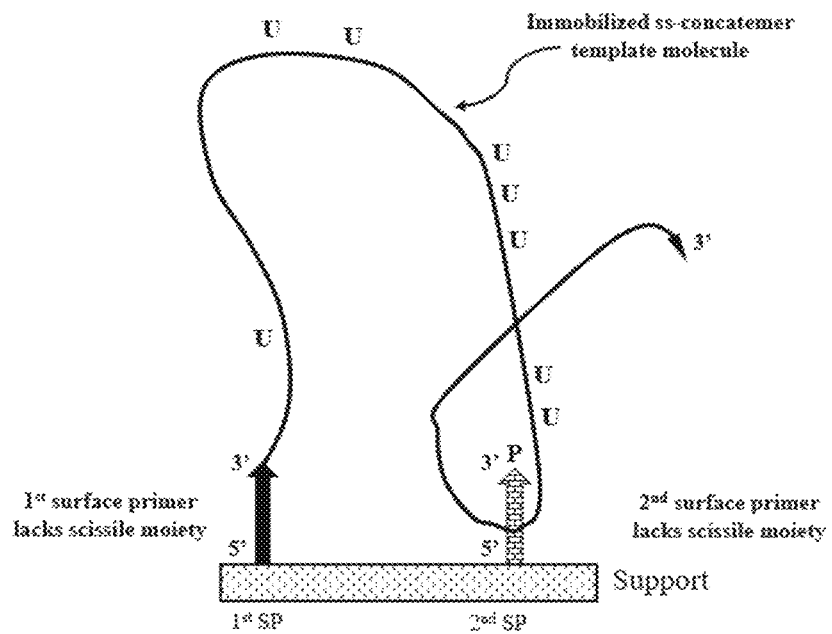

In some embodiments, the support further comprises a plurality of a second surface primer immobilized thereon (FIG. 37). The second surface primers have a sequence that differs from the first immobilized surface primer. The immobilized second surface primers of step (a) comprise single stranded oligonucleotides comprising DNA, RNA or a combination of DNA and RNA. The second surface primers comprise a sequence that is wholly complementary or partially complementary along their lengths to at least a portion of an immobilized single stranded concatemer template molecule. The immobilized second surface primers can be immobilized to the support or immobilized to a coating on the support. The immobilized second surface primers can be embedded and attached (coupled) to the coating on the support. In some embodiments, the 5' end of the immobilized second surface primers are immobilized to a support or immobilized to a coating on the support. Alternatively, an interior portion or the 3' end of the immobilized second surface primers can be immobilized to a support or immobilized to a coating on the support. The support comprises a plurality of immobilized second surface primers having the same sequence. The immobilized second surface primers can be any length, for example 4-50 nucleotides, or 50-100 nucleotides, or 100-150 nucleotides, or longer lengths. In some embodiments, the 3' terminal end of the immobilized second surface primers comprise an extendible 3' OH moiety. In some embodiments, the 3' terminal end of the immobilized second surface primers comprise a 3' non-extendible moiety. The 3' terminal end of the immobilized second surface primers comprise a moiety that blocks primer extension, such as for example a phosphate group, a dideoxycytidine group, an inverted dT, or an amino group. The immobilized second surface primers are not extendible in a primer extension reaction. The immobilized second surface primers lack a nucleotide having a scissile moiety.

In some embodiments, the plurality of immobilized second surface primers comprise at least one phosphorothioate diester bond at their 5' ends which can render the second surface primers resistant to exonuclease degradation. In some embodiments, the plurality of immobilized second surface primers comprise 2-5 or more consecutive phosphorothioate diester bonds at their 5' ends. In some embodiments, the plurality of immobilized second surface primers comprise at least one ribonucleotide and/or at least one 2'-O-methyl or 2'-O-methoxyethyl (MOE) nucleotide which can render the second surface primers resistant to exonuclease degradation.

In some embodiments, individual immobilized single stranded nucleic acid concatemer template molecule are covalently joined to an immobilized first surface primer, and at least one portion of the individual concatemer template molecule is hybridized to an immobilized second surface primer (FIG. 37). The immobilized second surface primers serve to pin down a portion of the immobilized concatemer template molecules to the support. The immobilized concatemer template molecule has two or more copies of a universal binding sequence for an immobilized second surface primer. The portion of the immobilized concatemer template molecule that includes the universal binding sequence for an immobilized second surface primer can hybridize to the immobilized second surface primer. In some embodiments, the second surface primers include a terminal 3' blocking group that renders them non-extendible. In some embodiments, the second surface primers have terminal 3' extendible ends.

In some embodiments, the support comprises about $10^2$-$10^{15}$ immobilized first surface primers per $mm^2$. In some embodiments, the support comprises about $10^2$-$10^{15}$ immobilized second surface primers per $mm^2$. In some embodiments, the support comprises about $10^2$-$10^{15}$ immobilized first surface primers and immobilized second surface primers per $mm^2$.

The immobilized surface primers (e.g., first and second surface primers) are in fluid communication with each other to permit flowing various solutions of linear or circular nucleic acid template molecules, soluble primers, enzymes, nucleotides, divalent cations, buffers, reagents, and the like, onto the support so that the plurality of immobilized surface primers (and the primer extension products generated from the immobilized surface primers) react with the solutions in a massively parallel manner.

Figure 26:
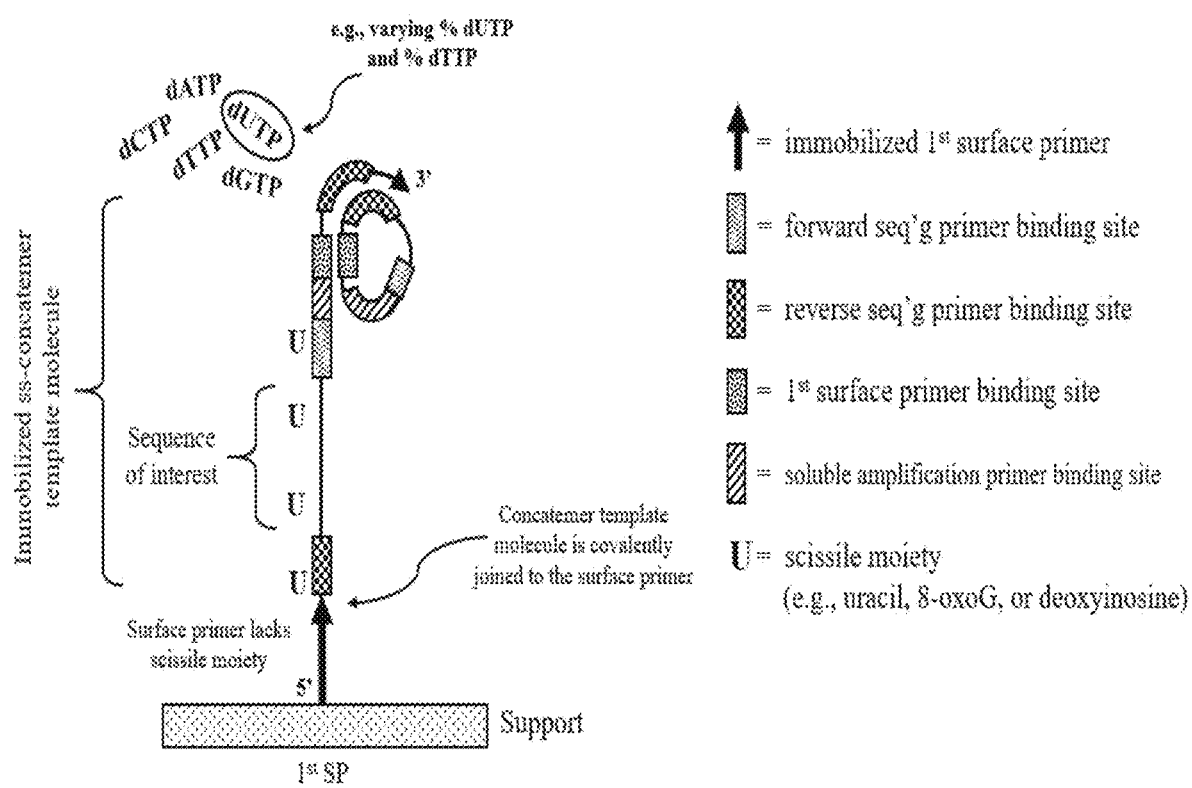
FIG. 26 is a schematic showing an exemplary on-support rolling circle amplification reaction using a nucleic acid circular library molecule, the immobilized first surface primer shown in FIG. 25, and a mixture of nucleotides including nucleotides having a scissile moiety that can be cleaved to generate an abasic site. The rolling circle amplification reaction generates an immobilized single stranded nucleic acid concatemer template molecule having at least one nucleotide with a scissile moiety which can be cleaved to generate an abasic site in the immobilized concatemer template molecule. The arrangement of the various primer binding sequences in the nucleic acid circular library molecule is for illustration purposes. The skilled artisan will appreciate that many other arrangements are possible.

In some embodiments, the pairwise sequencing method further comprises step (b): generating a plurality of immobilized single stranded nucleic acid concatemer template molecules wherein individual single stranded nucleic acid concatemer template molecules are joined (e.g., covalently joined) to an immobilized surface primer (e.g., an immobilized first surface primer), by hybridizing a plurality of single-stranded circular nucleic acid library molecules to the plurality of immobilized first surface primers and conducting a rolling circle amplification reaction with a plurality of a strand displacing polymerase, and a plurality of nucleotides which include dATP, dCTP, dGTP, dTTP and a nucleotide having a scissile moiety, thereby generating a plurality of immobilized single stranded nucleic acid concatemer template molecules (FIG. 26). In some embodiments, the rolling circle amplification reaction can be conducted in the presence, or in the absence, of a plurality of compaction oligonucleotides.

In some embodiments, the single-stranded circular nucleic acid library molecules comprise covalently closed circular molecules. In some embodiments, the single-stranded circular nucleic acid library molecules can be removed from the concatemer template molecules with at least one washing step which is conducted under a condition suitable to retain the single stranded nucleic acid concatemer template molecules where individual concatemer template molecules are operably joined to an immobilized first surface primer.

In some embodiments, each of the single stranded circular nucleic acid library molecules in the plurality comprise a sequence of interest, and wherein the individual immobilized concatemer template molecules further comprise any one or any combination of two or more of (i) a universal binding sequence (or complementary sequence thereof) for a soluble forward sequencing primer, (ii) a universal binding sequence (or complementary sequence thereof) for a soluble reverse sequencing primer, (iii) a universal binding sequence (or complementary sequence thereof) for an immobilized first surface primer, (iv) a universal binding sequence (or complementary sequence thereof) for an immobilized second surface primer, (v) a universal binding sequence (or complementary sequence thereof) for a first soluble amplification primer, (vi) a universal binding sequence (or complementary sequence thereof) for a second soluble amplification primer, (vii) a universal binding sequence (or complementary sequence thereof) for a soluble compaction oligonucleotide, (viii) a sample barcode sequence and/or (ix) a unique molecular index sequence.

In some embodiments, the universal binding sequence (or a complementary sequence thereof) for the forward sequencing primer can hybridize to at least a portion of the forward sequencing primer. In some embodiments, the universal binding sequence (or a complementary sequence thereof) for the reverse sequencing primer can hybridize to at least a portion of the reverse sequencing primer. In some embodiments, the universal binding sequence (or a complementary sequence thereof) for the immobilized first surface primer can hybridize to at least a portion of the immobilized first surface primer. In some embodiments, the universal binding sequence (or a complementary sequence thereof) for the immobilized second surface primer can hybridize to at least a portion of the immobilized second surface primer. In some embodiments, the universal binding sequence (or a complementary sequence thereof) for the first soluble amplification primer can hybridize to at least a portion of the first soluble amplification primer. In some embodiments, the universal binding sequence (or a complementary sequence thereof) for the second soluble amplification primer can hybridize to at least a portion of the second soluble amplification primer. In some embodiments, the universal binding sequence (or a complementary sequence thereof) for the soluble compaction oligonucleotide can hybridize to at least a portion of the soluble compaction oligonucleotide.

In some embodiments, the rolling circle amplification reaction of step (b) generates a plurality of immobilized single stranded nucleic acid concatemer template molecules each comprising a concatemer having at least one nucleotide having a scissile moiety and two or more copies of a sequence of interest, and wherein the immobilized concatemer template molecules further comprise any one or any combination of two or more of: (i) two or more copies of a universal binding sequence (or a complementary sequence thereof) for a soluble forward sequencing primer, (ii) two or more copies of a universal binding sequence (or a complementary sequence thereof) for a soluble reverse sequencing primer, (iii) two or more copies of a universal binding sequence (or a complementary sequence thereof) for an immobilized first surface primer, (iv) two or more copies of a universal binding sequence (or a complementary sequence thereof) for an immobilized second surface primer, (v) two or more copies of a universal binding sequence (or a complementary sequence thereof) for a first soluble amplification primer, (vi) two or more copies of a universal binding sequence (or a complementary sequence thereof) for a second soluble amplification primer, (vii) two or more copies of a universal binding sequence (or a complementary sequence thereof) for a soluble compaction oligonucleotide, (viii) two or more copies of a sample barcode sequence and/or (ix) two or more copies of a unique molecular index sequence.

In some embodiments, the plurality of immobilized single stranded nucleic acid concatemer template molecules that are generated by the rolling circle amplification reaction of step (b) further comprise two or more copies of a universal binding sequence (or complementary sequence thereof) for immobilized second sequence surface primers. In some embodiments, individual immobilized single stranded nucleic acid concatemer template molecule are joined (e.g., covalently joined) to an immobilized first surface primer, and at least one portion of the individual concatemer template molecule is hybridized to an immobilized second surface primer. The immobilized second surface primers serve to pin down a portion of the immobilized concatemer template molecules to the support (see FIG. 37). In some embodiments, the second surface primers include a terminal 3' blocking group that renders them non-extendible.

The rolling circle amplification reaction of step (b) can be conducted with a nucleotide mixture containing dATP, dCTP, dGTP, dTTP and a nucleotide having a scissile moiety to generate immobilized concatemer template molecules which includes at least one nucleotide having a scissile moiety. The scissile moieties in the immobilized concatemer template molecules can be converted into abasic sites. In some embodiments, in the nucleotide mixture, the nucleotide having the scissile moiety comprises uridine, 8-oxo-7, 8-dihydroguanine (e.g., 8oxoG) or deoxyinosine. In the immobilized concatemer template molecules, the uridine can be converted to an abasic site using uracil DNA glycosylase (UDG), the 8oxoG can be converted to an abasic site using FPG glycosylase, and the deoxyinosine can be converted to an abasic site using AlkA glycosylase.

In some embodiments, the nucleotide mixture can include an amount of dUTP so that a target percent of the thymidine in the resulting concatemer molecules are replaced with dUTP. For example, when 30% of dTTP in the concatemer molecules are to be replaced with dUTP (e.g., 30% is the target percent) then the nucleotide mixture can contain 7.5% dUTP (e.g., 30/4=7.5%), 17.5% dTTP, and 25% each for dATP, dCTP and dGTP. The target percent of dTTP to be replaced by dUTP can be about 0.1-1%, or about 1-5%, or about 5-10%, or about 10-20%, or about 20-30%, or about 30-45%, or about 45-50%, or a higher percent of the dTTP in the immobilized concatemer template molecules are replaced with nucleotides having a scissile moiety.

In some embodiments, the nucleotide mixture can include an amount of deoxyinosine so that a target percent of the guanosine in the resulting concatemer molecules are replaced with deoxyinosine. For example, when 30% of dGTP in the concatemer molecules are to be replaced with deoxyinosine (e.g., 30% is the target percent) then the nucleotide mixture can contain 7.5% deoxyinosine (e.g., 30/4=7.5%), 17.5% dGTP, and 25% each for dATP, dCTP and dTTP. The target percent of dGTP to be replaced by deoxyinosine can be about 0.1-1%, or about 1-5%, or about 5-10%, or about 10-20%, or about 20-30%, or about 30-45%, or about 45-50%, or a higher percent of the dGTP in the immobilized concatemer template molecules are replaced with nucleotides having a scissile moiety.

In some embodiments, the nucleotide mixture can include an amount of 8oxoG so that a target percent of the guanosine in the resulting concatemer molecules are replaced with 8oxoG. For example, when 30% of dGTP in the concatemer molecules are to be replaced with 8oxoG (e.g., 30% is the target percent) then the nucleotide mixture can contain 7.5% 8oxoG (e.g., 30/4=7.5%), 17.5% dGTP, and 25% each for dATP, dCTP and dTTP. The target percent of dGTP to be replaced by 8oxoG can be about 0.1-1%, or about 1-5%, or about 5-10%, or about 10-20%, or about 20-30%, or about 30-45%, or about 45-50%, or a higher percent of the dGTP in the immobilized concatemer template molecules are replaced with nucleotides having a scissile moiety.

In some embodiments, the rolling circle amplification reaction generates immobilized concatemer template molecules with incorporated nucleotides having a scissile moiety that are distributed at random positions along individual immobilized concatemer template molecules. In some embodiments, the nucleotides having a scissile moiety are distributed at different positions in the different immobilized concatemer template molecules.

Figure 27:
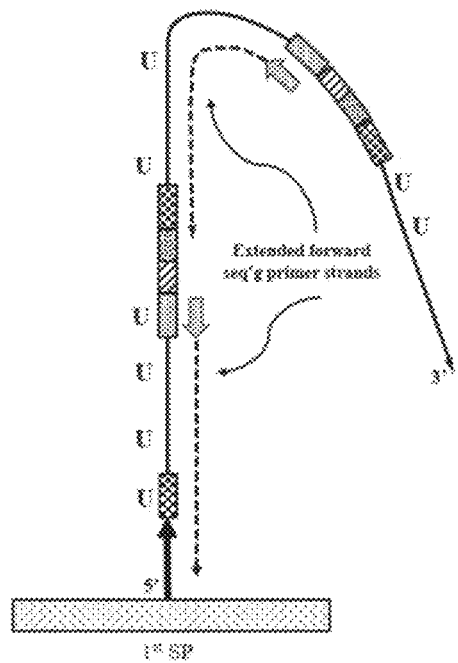

In some embodiments, the pairwise sequencing method further comprises step (c): sequencing the plurality of immobilized concatemer template molecules thereby generating a plurality of extended forward sequencing primer strands. The sequencing of step (c) comprises contacting the plurality of immobilized concatemer template molecules with a plurality of soluble forward sequencing primers under a condition suitable to hybridize at least one forward sequencing primer to at least one of the forward sequencing primer binding sites/sequences of the immobilized concatemer template molecules, and conducting forward sequencing reactions using one or more types of sequencing polymerases, a plurality of nucleotides and/or multivalent molecules, and the hybridized first forward sequencing primers (FIG. 27). In some embodiments, the soluble forward sequencing primers comprise 3' OH extendible ends. In some embodiments, the soluble forward sequencing primers comprise a 3' blocking moiety which can be removed to generate a 3' OH extendible end. In some embodiments, the soluble forward sequencing primers lack a nucleotide having a scissile moiety. The forward sequencing reactions can generate a plurality of extended forward sequencing primer strands. In some embodiments, individual immobilized concatemer template molecules have multiple copies of the forward sequencing primer binding sites, wherein each forward sequencing primer binding site is capable of hybridizing to a first forward sequencing primer. Individual forward sequencing primer binding sites in a given immobilized concatemer template molecule can be hybridized to a forward sequencing primer and can undergo a sequencing reaction. Individual immobilized concatemer template molecules can undergo two or more sequence reactions, where each sequencing reaction is initiated from a first forward sequencing primer that is hybridized to a forward sequencing primer binding site (e.g., see FIG. 27). In some embodiments, the sequencing reactions comprise a plurality of nucleotides (or analogs thereof) labeled with a detectable reporter moiety. In some embodiments, the sequencing reaction comprise a plurality of multivalent molecules having a plurality of nucleotide units attached to a core, where the multivalent molecules are labeled with a detectable reporter moiety. In some embodiments, the core is labeled with a detectable reporter moiety. In some embodiments, at least one linker and/or at least one nucleotide unit of a nucleotide arm is labeled with a detectable reporter moiety. In some embodiments, the detectable reporter moiety comprises a fluorophore. An exemplary nucleotide arm is shown in FIG. 108, and exemplary multivalent molecules are shown in FIGS. 104-107.

In some embodiments, the sequencing polymerases of step (c) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (c) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

Figure 28:
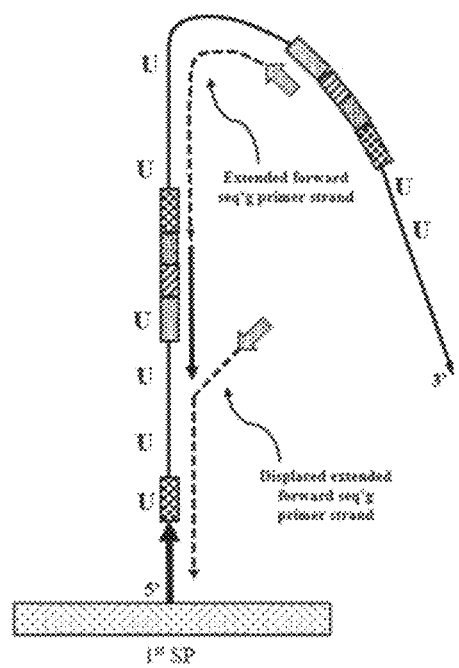

In some embodiments, the pairwise sequencing method further comprises step (d): retaining the plurality of immobilized concatemer template molecules and replacing the plurality of extended forward sequencing primer strands with a plurality of forward extension strands that are hybridized to the retained immobilized single stranded nucleic acid concatemer template molecules. The plurality of extended forward sequencing primer strands can be removed and replaced with a plurality of forward extension strands by conducting a primer extension reaction (see FIGS. 28-30). In some embodiments, step (d) comprises contacting at least one extended forward sequencing primer strand with a plurality of strand displacing polymerases and a plurality of nucleotides and in the absence of soluble amplification primers, under a condition suitable to conduct a strand displacing primer extension reaction using the at least one extended forward sequencing primers strand to initiate the primer extension reaction thereby generating a forward extension strand that is covalently joined to the extended forward sequencing primers strand, wherein the forward extension strand is hybridized to the immobilized concatemer template molecule (FIG. 28). For example, one of the extended forward sequencing primer strands can serve as a primer for the strand displacing polymerase. The strand displacing polymerase can extend the extended forward sequencing primer strand, and displace downstream extended forward sequencing primer strands while synthesizing an extended strand that replaces the downstream extended forward sequencing primer strands. The newly extended strand is covalently joined to an extended forward sequencing primer strand. The immobilized concatemer template molecules are retained. The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine III). Inclusion of compaction oligonucleotides and/or hexamine (e.g., cobalt hexamine III) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 μm or smaller.

Examples of strand displacing polymerases include phi29 DNA polymerase, large fragment of Bst DNA polymerase, large fragment of Bsu DNA polymerase (exo-), Bca DNA polymerase (exo-), Klenow fragment of E. coli DNA polymerase, T5 polymerase, M-MuLV reverse transcriptase, HIV viral reverse transcriptase, Deep Vent® DNA polymerase and KOD DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio).

Figure 29:
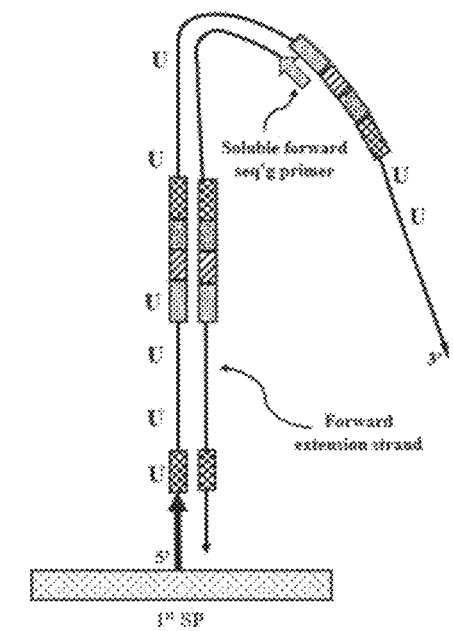

In some embodiments, step (d) comprises: (i) removing the plurality of extended forward sequencing primer strand while retaining the immobilized concatemer template molecules; and (ii) contacting the plurality of retained immobilized concatemer molecules with a plurality of soluble forward sequencing primers (e.g., a second plurality of soluble forward sequencing primers), a plurality of nucleotides (e.g., a second plurality of nucleotides) and a plurality of primer extension polymerases, under a condition suitable to hybridize the plurality of soluble forward sequencing primers to the plurality of retained immobilized concatemer template molecules and suitable for conducting polymerase-catalyzed primer extension reactions thereby generating a plurality of forward extension strands, wherein the soluble sequencing primers hybridize with the forward sequencing primer binding sequence in the retained immobilized concatemer molecules (FIG. 29). The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine III). Inclusion of compaction oligonucleotides and/or hexamine (e.g., cobalt hexamine III) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 μm or smaller.

In some embodiments, in step (d), the condition suitable to hybridize the plurality of soluble forward sequencing primers to the plurality of retained immobilized single stranded nucleic acid concatemer template molecules comprises hybridizing retained immobilized concatemer template molecules with the soluble primers in the presence of a primer extension polymerase, a plurality of nucleotides, and a high efficiency hybridization buffer. In some embodiment, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10/a by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

Figure 30:
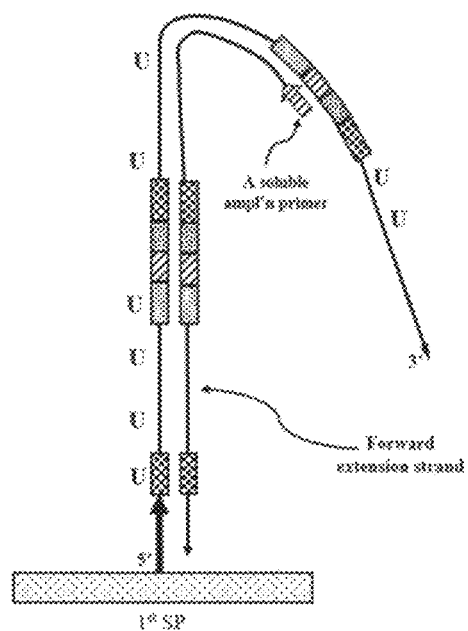

In some embodiments, step (d) comprises: (i) removing the plurality of extended forward sequencing primer strand while retaining the immobilized concatemer template molecules; and (ii) contacting the plurality of retained immobilized concatemer molecules with a plurality of soluble amplification primers, a plurality of nucleotides (e.g., a second plurality of nucleotides) and a plurality of primer extension polymerases, under a condition suitable to hybridize the plurality of soluble amplification primers to the plurality of retained immobilized concatemer template molecules and suitable for conducting polymerase-catalyzed primer extension reactions thereby generating a plurality of forward extension strands, wherein the soluble amplification primers hybridize with the soluble amplification primer binding sequence in the retained immobilized concatemer molecules (FIG. 30). The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine III). Inclusion of compaction oligonucleotides and/or hexamine (e.g., cobalt hexamine III) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 μm or smaller.

In some embodiments, in step (d), the condition suitable to hybridize the plurality of soluble amplification primers to the plurality of retained immobilized single stranded nucleic acid concatemer template molecules comprises hybridizing retained immobilized concatemer template molecules with the soluble primers in the presence of a primer extension polymerase, a plurality of nucleotides, and a high efficiency hybridization buffer. In some embodiment, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, in step (d), the plurality of extended forward sequencing primer strands can be removed using an enzyme or a chemical reagent. For example, the plurality of extended forward sequencing primer strands can be enzymatically degraded using a 5' to 3' double-stranded DNA exonuclease, including T7 exonuclease (e.g., from New England Biolabs, catalog #M0263S). In some embodiments, the plurality of extended forward sequencing primer strands can be removed with a temperature that favors nucleic acid denaturation.

In some embodiments, in step (d), a denaturation reagent can be used to remove the plurality of extended forward sequencing primer strands, wherein the denaturation reagent comprises any one or any combination of compounds such as formamide, acetonitrile, guanidinium chloride and/or a buffering agent (e.g., Tris-HCl, MES, HEPES, or the like).

In some embodiments, in step (d), the plurality of extended forward sequencing primer strands can be removed using an elevated temperature (e.g., heat) with or without a nucleic acid denaturation reagent. The plurality of extended forward sequencing primer strands can be subjected to a temperature of about 45-50° C., or about 50-60° C., or about 60-70° C., or about 70-80° C., or about 80-90° C., or about 90-95° C., or higher temperature.

In some embodiments, in step (d), the plurality of extended forward sequencing primer strands can be removed using 100% formamide at a temperature of about 65° C. for about 3 minutes, and washing with a reagent comprising about 50 mM NaCl or equivalent ionic strength and having a pH of about 6.5-8.5.

In some embodiments, the primer extension polymerase of step (d) comprises a high fidelity polymerase. In some embodiments, the primer extension polymerase of step (d) comprises a DNA polymerase capable of catalyzing a primer extension reaction using a uracil-containing template molecule (e.g., a uracil-tolerant polymerase). Exemplary polymerases include, but are not limited to, Q5U® Hot Start high-fidelity DNA polymerase (e.g., catalog #M0515S from New England Biolabs), Taq DNA polymerase, OneTaq® DNA polymerase (e.g., mixture of Taq and Deep Vent® DNA polymerases, catalog #M0480S from New England Biolabs), LongAmp® Taq DNA polymerase (e.g., catalog #M0323S from New England Biolabs), EpiMark® Hot Start Taq DNA polymerase (e.g., catalog #M0490S from New England Biolabs), Bst DNA polymerase (e.g., large fragment, catalog #M0275S from New England Biolabs), Bsu DNA polymerase (e.g., large fragment, catalog #M0330S from New England Biolabs), Phi29 DNA polymerase (e.g., catalog #M0269S from New England Biolabs), E. coli DNA polymerase (e.g., catalog #M0209S from New England Biolabs), Therminator™ DNA polymerase (e.g., catalog #M0261S from New England Biolabs), Vent® DNA polymerase and Deep Vent® DNA polymerase.

The pairwise methods described herein can provide increased accuracy in a downstream sequencing reaction because step (d) replaces the extended forward sequencing primer strands that were generated in step (c) with forward extension strands having reduced base errors. The extended forward sequencing primer strands are generated in step (c) and may or may not contain erroneously incorporated nucleotides due to polymerase-catalyzed mis-paired bases. When step (d) is conducted with a high fidelity DNA polymerase, the resulting forward extension strands may have reduced base errors compared to the extended forward sequencing primer strands. The forward extension strands will be used as a nucleic acid template for a downstream sequencing step (e.g., see step (f) below). Thus, step (d) can increase the sequencing accuracy of the downstream step (f) and therefore increase the overall sequencing accuracy of the pairwise sequencing workflow.

Figures 31, 32:
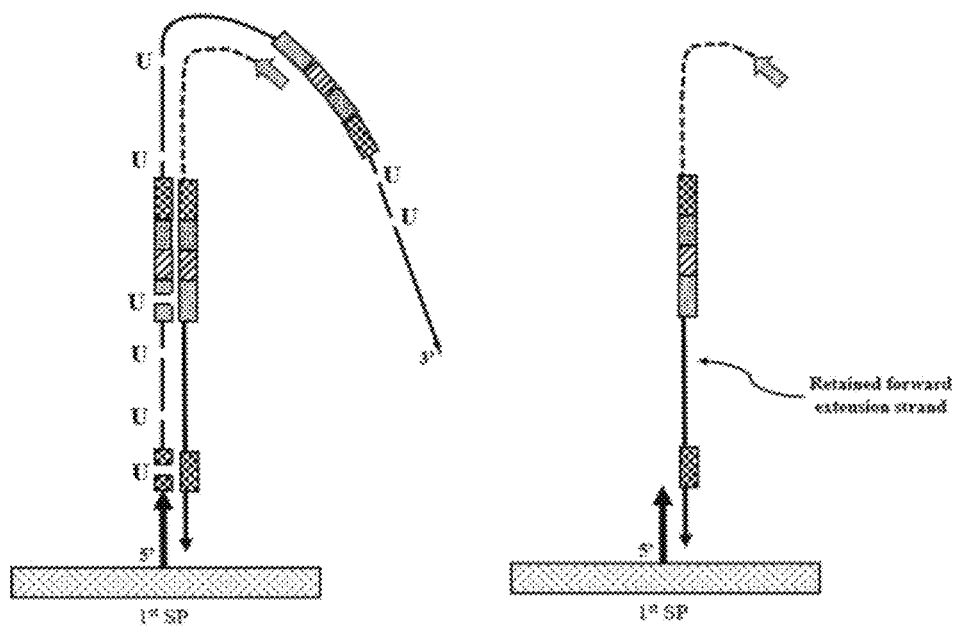
Figures 33, 34:
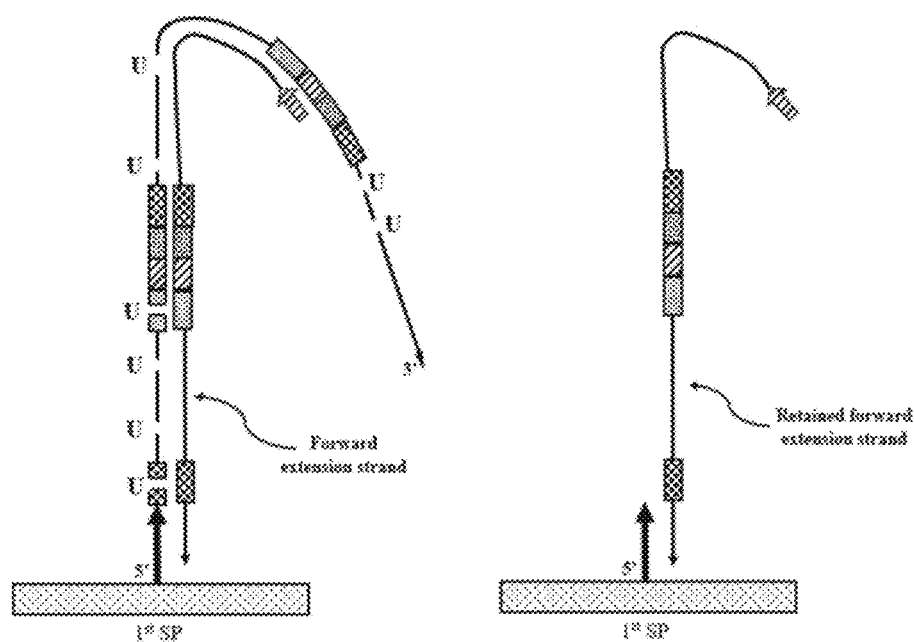

In some embodiments, the pairwise sequencing method further comprises step (e): removing the retained immobilized concatemer template molecules by generating abasic sites in the immobilized single stranded concatemer template molecules at the nucleotide(s) having the scissile moiety and generating gaps at the abasic sites to generate a plurality of gap-containing single stranded nucleic acid concatemer template molecules while retaining the plurality of forward extension strands and retaining the plurality of immobilized surface primers (FIGS. 31 and 33).

The abasic sites are generated on the retained concatemer template strands that contain nucleotides having scissile moieties. In some embodiments, the scissile moieties in the retained concatemer template molecules comprises uridine, 8-oxo-7,8-dihydroguanine (e.g., 8oxoG) or deoxyinosine. The abasic sites can be removed to generate a plurality of single stranded nucleic acid template molecules having gaps while retaining the plurality of forward extension strands. The abasic sites can be generated by contacting the immobilized concatemer template molecules with an enzyme that removes the nucleo-base at the nucleotide having the scissile moiety. The uracil in the retained concatemer template strands can be converted to an abasic site using uracil DNA glycosylase (UDG). The 8oxoG in the retained concatemer template strands can be converted to an abasic site using FPG glycosylase. The deoxyinosine in the retained concatemer template strands can be converted to an abasic site using AlkA glycosylase.

In some embodiments, in step (e), the gaps can be generated by contacting the abasic sites in the immobilized concatemer template molecules with an enzyme or a mixture of enzymes having lyase activity that breaks the phosphodiester backbone at the 5' and 3' sides of the abasic site to release the base-free deoxyribose and generate a gap (FIGS. 31 and 33). The abasic sites can be removed using AP lyase, Endo IV endonuclease, FPG glycosylase/AP lyase, Endo VIII glycosylase/AP lyase. In some embodiments, generating the abasic sites and removal of the abasic sites to generate gaps can be achieved using a mixture of uracil DNA glycosylase and DNA glycosylase-lyase endonuclease VIII, for example USER™ (Uracil-Specific Excision Reagent Enzyme from New England Biolabs) or thermolabile USER™ (also from New England Biolabs).

In some embodiments, in step (e), the plurality of gap-containing template molecules can be removed using an enzyme, chemical compound and/or heat. After the gap-removal procedure, the plurality of retained forward extension strands are hybridized to the retained immobilized surface primers (FIGS. 32 and 34).

For example, the plurality of gap-containing template molecules can be enzymatically degraded using a 5' to 3' double-stranded DNA exonuclease, including T7 exonuclease (e.g., from New England Biolabs, catalog #M0263S). When a 5' to 3' double-stranded DNA exonuclease is used for removing gap-containing template molecules, then the plurality of soluble amplification primers in step (e) can comprise at least one phosphorothioate diester bond at their 5' ends which can render the soluble amplification primers resistant to exonuclease degradation. In some embodiments, the plurality of soluble amplification primers in step (d) comprise 2-5 or more consecutive phosphorothioate diester bonds at their 5' ends. In some embodiments, the plurality soluble amplification primers in step (d) comprise at least one ribonucleotide and/or at least one 2'-O-methyl or 2'-O-methoxyethyl (MOE) nucleotide which can render the forward sequencing primers resistant to exonuclease degradation.

In some embodiments, the plurality of gap-containing template molecules can be removed using a chemical reagent that favors nucleic acid denaturation. The denaturation reagent can include any one or any combination of compounds such as formamide, acetonitrile, guanidinium chloride and/or a buffering agent (e.g., Tris-HCl, MES, HEPES, or the like).

In some embodiments, the plurality of gap-containing template molecules can be removed using an elevated temperature (e.g., heat) with or without a nucleic acid denaturation reagent. The gap-containing template molecules can be subjected to a temperature of about 45-50° C., or about 50-60° C., or about 60-70° C., or about 70-80° C., or about 80-90° C., or about 90-95° C., or higher temperature.

In some embodiments, the plurality of gap-containing template molecules can be removed using 100% formamide at a temperature of about 65° C. for about 3 minutes, and washing with a reagent comprising about 50 mM NaCl or equivalent ionic strength and having a pH of about 6.5-8.5.

Figures 35, 36:
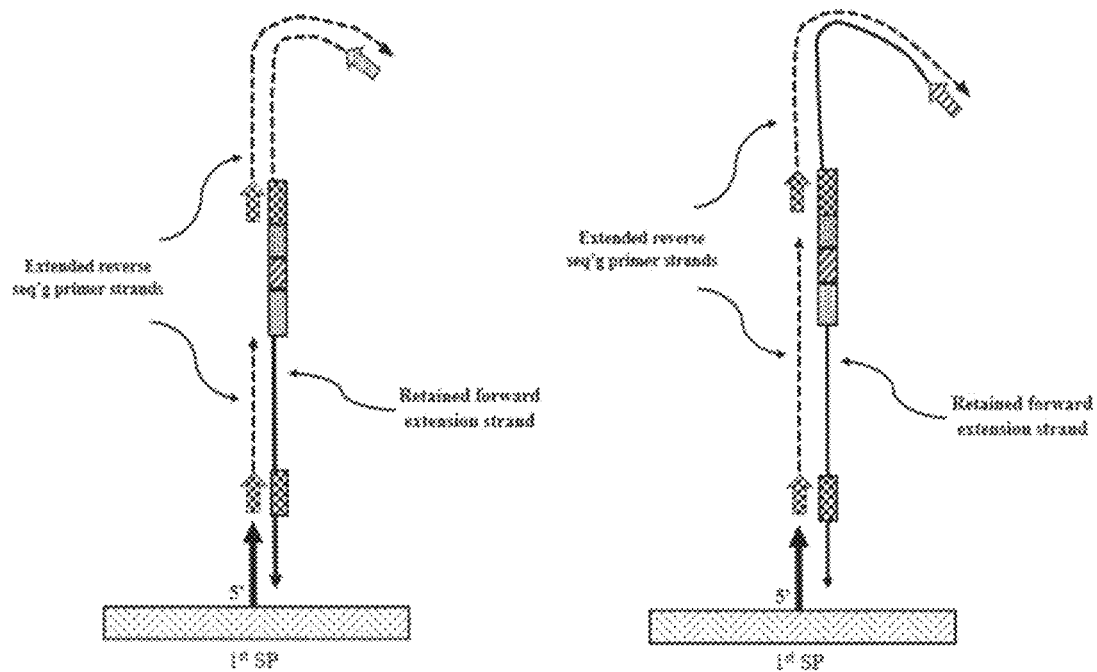

In some embodiments, the pairwise sequencing method further comprises step (f): sequencing the plurality of retained forward extension strands thereby generating a plurality of extended reverse sequencing primer strands. In some embodiments, the sequencing of step (f) comprises contacting the plurality of retained forward extension strands with a plurality of soluble reverse sequencing primers under a condition suitable to hybridize the reverse sequencing primers to the reverse sequencing primer binding site of the retained forward extension strands, and by conducting sequencing reactions using the hybridized reverse sequencing primers wherein the forward sequencing reactions generates a plurality of extended reverse sequencing primer strands (FIGS. 35 and 36). The extended reverse sequencing primer strands are hybridized to the retained forward extension strand. The retained forward extension strand is hybridized to the first surface primer. The extended reverse sequencing primer strands are not hybridized to the first surface primer, or covalently joined to the first surface primer. Therefore, the extended reverse sequencing primer strands are not immobilized to the support.

For the sake of simplicity, FIGS. 32 and 34 show exemplary retained forward extension strands each having one copy of the sequence of interest and various universal primer binding sites. The skilled artisan will appreciate that the retained forward extension strand can include two or more tandem copies containing the sequence of interest and various universal primer binding sites. Therefore, the reverse sequencing reaction can generate a plurality of extended reverse sequencing primer strands hybridized to the same retained forward extension strand.

In some embodiments, in step (f), the condition suitable to hybridize the reverse sequencing primers to the reverse sequencing primer binding sequences of the retained forward extension strands comprises contacting the plurality of soluble reverse sequencing primers and the retained forward extension strands with a high efficiency hybridization buffer. In some embodiments, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50/a by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In an alternative embodiment, the sequencing of step (f) comprises using the immobilized surface primer as a sequencing primer and conducting sequencing reactions to generate a plurality of reverse sequencing strands.

In some embodiments, the reverse sequencing reactions of step (f) comprises contacting the plurality of reverse sequencing primers with the reverse sequencing primer binding sequences of the retained forward extension strands, one or more types of sequencing polymerases, and a plurality of nucleotides and/or a plurality of multivalent molecules. In some embodiments, the soluble reverse sequencing primers comprise 3' OH extendible ends. In some embodiments, the soluble reverse sequencing primers comprise a 3' blocking moiety which can be removed to generate a 3' OH extendible end. In some embodiments, the soluble reverse sequencing primers lack a nucleotide having a scissile moiety. The sequencing reactions that employ nucleotides and/or multivalent molecules is described in more detail below. The reverse sequencing reactions can generate a plurality of extended reverse sequencing primer strands. In some embodiments, individual retained forward extension strands have multiple copies of the reverse sequencing primer binding sequences/sites, wherein each reverse sequencing primer binding site is capable of hybridizing to a reverse sequencing primer. Individual reverse sequencing primer binding sites in a given retained forward extension strand can be hybridized to a reverse sequencing primer and can undergo a sequencing reaction. Thus, an individual retained forward extension strand can undergo two or more sequence reactions, where each sequencing reaction is initiated from a reverse sequencing primer that is hybridized to a reverse sequencing primer binding site (e.g., see FIGS. 35 and 36). In some embodiments, the sequencing reactions comprise a plurality of nucleotides (or analogs thereof) labeled with a detectable reporter moiety. In some embodiments, the sequencing reaction comprise a plurality of multivalent molecules having nucleotide units, where the multivalent molecules are labeled with a detectable reporter moiety. In some embodiments, the detectable reporter moiety comprises a fluorophore.

In some embodiments, the sequencing polymerases of step (f) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (f) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

In some embodiments, at least one washing step can be conducted after any of steps (a)-(f). The washing step can be conducted with a wash buffer comprising a pH buffering agent, a metal chelating agent, a salt, and a detergent.

In some embodiments, the pH buffering compound in the wash buffer comprises any one or any combination of two or more of Tris, Tris-HCl, Tricine, Bicine, Bis-Tris propane, HEPES, MES, MOPS, MOPSO, BES, TES, CAPS, TAPS, TAPSO, ACES, PIPES, ethanolamine (a.k.a 2-amino methanol; MEA), a citrate compound, a citrate mixture, NaOH and/or KOH. In some embodiments, the pH buffering agent can be present in the wash buffer at a concentration of about 1-100 mM, or about 10-50 mM, or about 10-25 mM. In some embodiments, the pH of the pH buffering agent which is present in any of the reagents described here in can be adjusted to a pH of about 4-9, or a pH of about 5-9, or a pH of about 5-8.

In some embodiments, the metal chelating agent in the wash buffer comprises EDTA (ethylenediaminetetraacetic acid), EGTA (ethylene glycol tetraacetic acid), HEDTA (hydroxyethylethylenediaminetriacetic acid), DPTA (diethylene triamine pentaacetic acid), NTA (N,N-bis(carboxymethyl)glycine), citrate anhydrous, sodium citrate, calcium citrate, ammonium citrate, ammonium bicitrate, citric acid, potassium citrate, or magnesium citrate. In some embodiments, the wash buffer comprises a chelating agent at a concentration of about 0.01-50 mM, or about 0.1-20 mM, or about 0.2-10 mM.

In some embodiments, the salt in the wash buffer comprises NaCl, KCl, $NH_2SO_4$ or potassium glutamate. In some embodiments, the detergent comprises an ionic detergent such as SDS (sodium dodecyl sulfate). The wash buffer can include a monovalent salt at a concentration of about 25-500 mM, or about 50-250 mM, or about 100-200 mM.

In some embodiments, the detergent in the wash buffer comprises a non-ionic detergent such as Triton X-100, Tween 20, Tween 80 or Nonidet P-40. In some embodiments, the detergent comprises a zwitterionic detergent such as CHAPS (3-[(3-cholamidopropyl)dimethylammonio]-1-propanesulfonate) or N-Dodecyl-N,N-dimethyl-3-amonio-1-propanesulfate (DetX). In some embodiments, the detergent comprises LDS (lithium dodecyl sulfate), sodium taurodeoxycholate, sodium taurocholate, sodium glycocholate, sodium deoxycholate or sodium cholate. In some embodiments, the detergent is included in the wash buffer at a concentration of about 0.01-0.05%, or about 0.05-0.1%, or about 0.1-0.15%, or about 0.15-0.2%, or about 0.2-0.25%.

In Solution RCA and Pairwise Sequencing—Generating Abasic Sites

Figure 38:
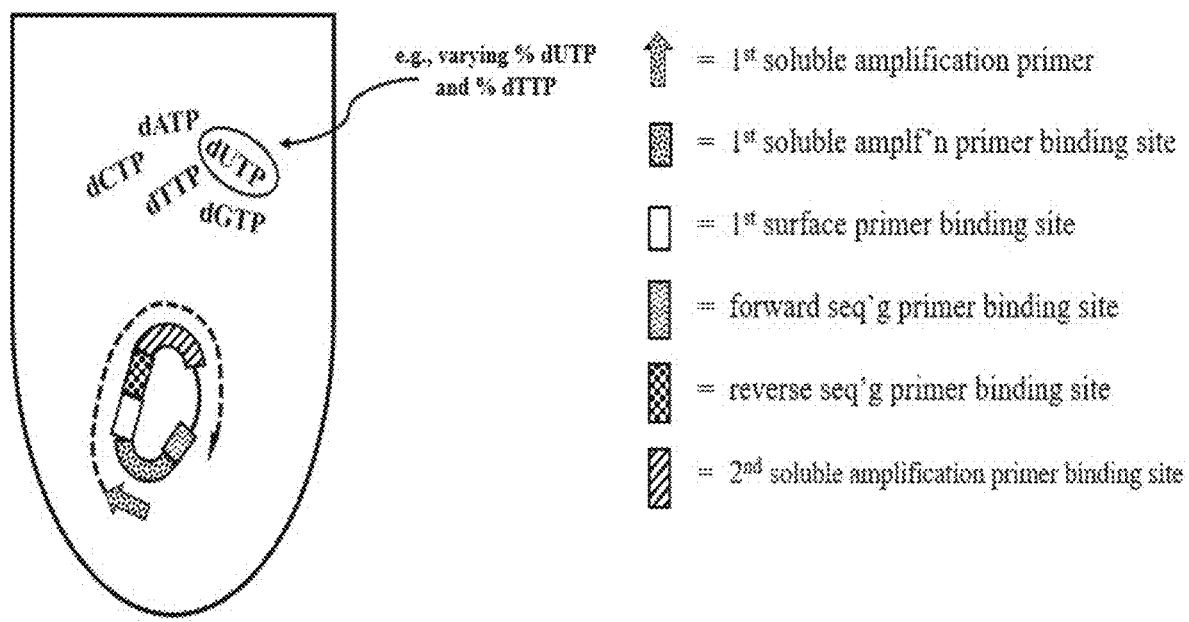
FIG. 38 is a schematic showing an exemplary in-solution rolling circle amplification reaction using a nucleic acid circular library molecule, a soluble first amplification primer, and a mixture of nucleotides including nucleotides having a scissile moiety that can be cleaved to generate an abasic site. The rolling circle amplification reaction generates in solution single stranded nucleic acid concatemer molecules having at least one nucleotide with a scissile moiety which can be cleaved to generate an abasic site in the concatemer molecule. The arrangement of the various primer binding sequences in the nucleic acid circular library molecule is for illustration purposes. The skilled artisan will appreciate that many other arrangements are possible.

The present disclosure provides pairwise sequencing methods, comprising step (a): contacting in-solution a plurality of single-stranded circular nucleic acid library molecules to a plurality of soluble first amplification primers, a plurality of a strand displacing polymerase, and a plurality of nucleotides which include dATP, dCTP, dGTP, dTTP and a nucleotide having a scissile moiety, under a condition suitable to form a plurality of library-primer duplexes and suitable for conducting a rolling circle amplification reaction, thereby generating a plurality of single stranded nucleic acid concatemers having at least one nucleotide with a scissile moiety (FIG. 38). In some embodiments, the soluble first amplification primer comprises a sequence that selectively hybridizes to a universal binding sequence in the circular nucleic acid library molecules, such as for example a universal binding sequence (or a complementary sequence thereof) for the first soluble amplification primer. Alternatively, the soluble first amplification primer comprises a random sequence that binds non-selectively to a sequence in the circular nucleic acid library molecules.

In some embodiments, individual single stranded circular nucleic acid library molecules in the plurality comprises a sequence of interest and wherein the individual library molecules further comprise any one or any combination of two or more of (i) a universal binding sequence (or a complementary sequence thereof) for a soluble forward sequencing primer, (ii) a universal binding sequence (or a complementary sequence thereof) for a soluble reverse sequencing primer, (iii) a universal binding sequence (or a complementary sequence thereof) for an immobilized first surface primer, (iv) a universal binding sequence (or a complementary sequence thereof) for an immobilized second surface primer, (v) a universal binding sequence (or a complementary sequence thereof) for a first soluble amplification primer, (vi) a universal binding sequence (or a complementary sequence thereof) for a second soluble amplification primer, (vii) a universal binding sequence (or a complementary sequence thereof) for a soluble compaction oligonucleotide, (viii) a sample barcode sequence and/or (ix) a unique molecular index sequence. In some embodiments, the single-stranded circular nucleic acid library molecules comprise covalently closed circular molecules.

In some embodiments, the rolling circle amplification reaction of step (a) generates a plurality of single stranded nucleic acid concatemer molecules in solution, comprising a concatemer having at least one nucleotide having a scissile moiety. In some embodiments, individual concatemer template molecules in the plurality comprise two or more copies of a sequence of interest, and wherein the individual immobilized concatemer template molecules further comprise any one or any combination of two or more of: (i) two or more copies of a universal binding sequence for a soluble forward sequencing primer, (ii) two or more copies of a universal binding sequence for a soluble reverse sequencing primer, (iii) two or more copies of a universal binding sequence for an immobilized first surface primer, (iv) two or more copies of a universal binding sequence for an immobilized second surface primer, (v) two or more copies of a universal binding sequence for a first soluble amplification primer, (vi) two or more copies of a universal binding sequence for a second soluble amplification primer, (vii) two or more copies of a universal binding sequence for a soluble compaction oligonucleotide, (viii) two or more copies of a sample barcode sequence and/or (ix) two or more copies of a unique molecular index sequence.

In some embodiments, the universal binding sequence (or a complementary sequence thereof) for the forward sequencing primer can hybridize to at least a portion of the forward sequencing primer. In some embodiments, the universal binding sequence (or a complementary sequence thereof) for the reverse sequencing primer can hybridize to at least a portion of the reverse sequencing primer. In some embodiments, the universal binding sequence (or a complementary sequence thereof) for the immobilized first surface primer can hybridize to at least a portion of the immobilized first surface primer. In some embodiments, the universal binding sequence (or a complementary sequence thereof) for the immobilized second surface primer can hybridize to at least a portion of the immobilized second surface primer. In some embodiments, the universal binding sequence (or a complementary sequence thereof) for the first soluble amplification primer can hybridize to at least a portion of the first soluble amplification primer. In some embodiments, the universal binding sequence (or a complementary sequence thereof) for the second soluble amplification primer can hybridize to at least a portion of the second soluble amplification primer. In some embodiments, the universal binding sequence (or a complementary sequence thereof) for the soluble compaction oligonucleotide can hybridize to at least a portion of the soluble compaction oligonucleotide.

The in-solution rolling circle amplification reaction of step (a) can be conducted with a nucleotide mixture containing dATP, dCTP, dGTP, dTTP and a nucleotide having a scissile moiety to generate the concatemer molecules which includes at least one nucleotide having a scissile moiety. The scissile moieties in the concatemer molecules can be converted into abasic sites. In some embodiments, in the nucleotide mixture, the nucleotide having the scissile moiety comprises uridine, 8-oxo-7,8-dihydroguanine (e.g., 8oxoG) or deoxyinosine. In the concatemer molecules, the uridine can be converted to an abasic site using uracil DNA glycosylase (UDG), the 8oxoG can be converted to an abasic site using FPG glycosylase, and the deoxyinosine can be converted to an abasic site using AlkA glycosylase.

In some embodiments, the nucleotide mixture can include an amount of dUTP so that a target percent of the thymidine in the resulting concatemer molecules are replaced with dUTP. For example, when 30% of dTTP in the concatemer molecules are to be replaced with dUTP (e.g., 30/6 is the target percent) then the nucleotide mixture can contain 7.5% dUTP (e.g., 30/4=7.5%), 17.5% dTTP, and 25% each for dATP, dCTP and dGTP. The target percent of dTTP to be replaced by dUTP can be about 0.1-1%, or about 1-5%, or about 5-10%, or about 10-20%, or about 20-30%, or about 30-45%, or about 45-50%, or a higher percent of the dTTP in the concatemer molecules are replaced with nucleotides having a scissile moiety.

In some embodiments, the nucleotide mixture can include an amount of deoxyinosine so that a target percent of the guanosine in the resulting concatemer molecules are replaced with deoxyinosine. For example, when 30% of dGTP in the concatemer molecules are to be replaced with deoxyinosine (e.g., 30% is the target percent) then the nucleotide mixture can contain 7.5% deoxyinosine (e.g., 30/4=7.5%), 17.5% dGTP, and 25% each for dATP, dCTP and dTTP. The target percent of dGTP to be replaced by deoxyinosine can be about 0.1-1%, or about 1-5%, or about 5-10%, or about 10-20%, or about 20-30%, or about 30-45%, or about 45-50%, or a higher percent of the dGTP in the concatemer molecules are replaced with nucleotides having a scissile moiety.

In some embodiments, the nucleotide mixture can include an amount of 8oxoG so that a target percent of the guanosine in the resulting concatemer molecules are replaced with 8oxoG. For example, when 30% of dGTP in the concatemer molecules are to be replaced with 8oxoG (e.g., 30% is the target percent) then the nucleotide mixture can contain 7.5% 8oxoG (e.g., 30/4=7.5%), 17.5% dGTP, and 25% each for dATP, dCTP and dTTP. The target percent of dGTP to be replaced by 8oxoG can be about 0.1-1%, or about 1-5%, or about 5-10%, or about 10-20%, or about 20-30%, or about 30-45%, or about 45-50%, or a higher percent of the dGTP in the concatemer molecules are replaced with nucleotides having a scissile moiety.

In some embodiments, the in-solution rolling circle amplification reaction generates concatemer molecules with incorporated nucleotides having a scissile moiety that are distributed at random positions along individual immobilized concatemer template molecules. In some embodiments, the nucleotides having a scissile moiety are distributed at different positions in the different concatemer molecules.

Figure 39:
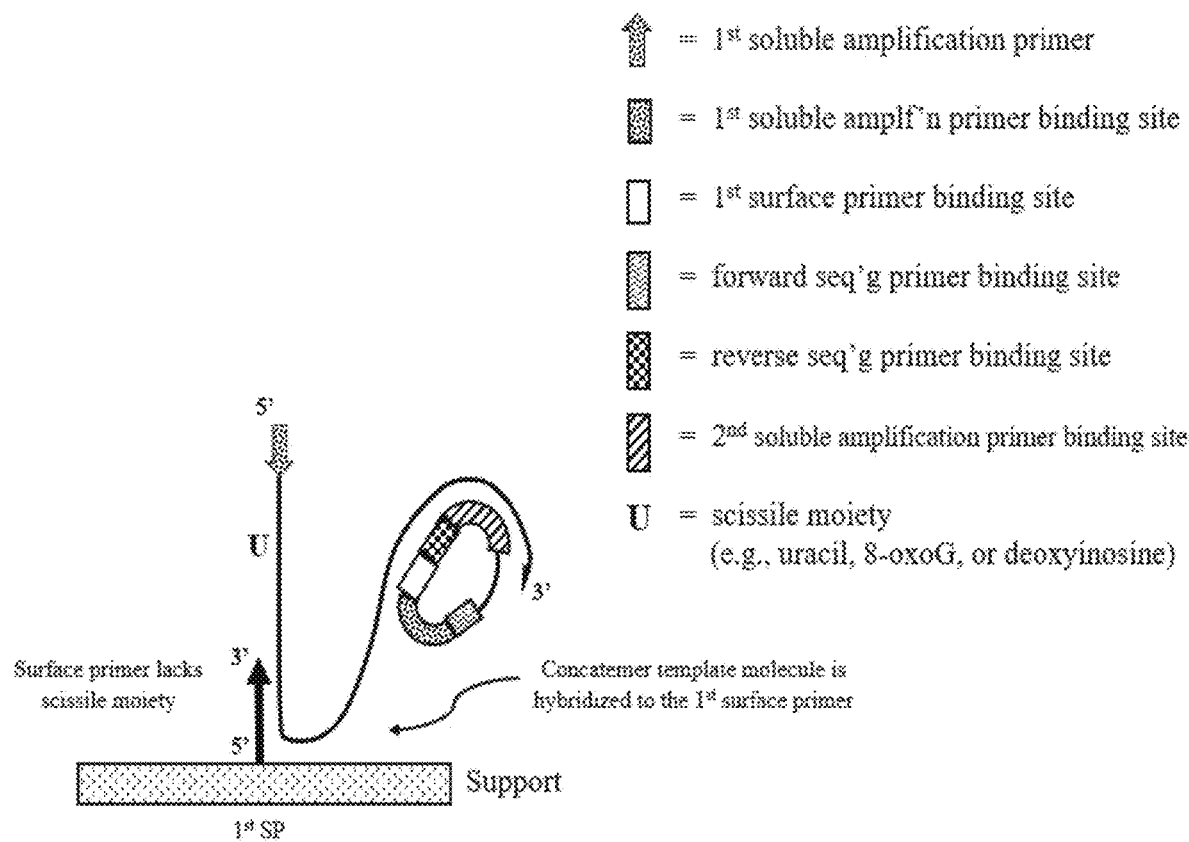

In some embodiments, the pairwise sequencing method further comprises step (b): distributing the rolling circle amplification reaction from step (a) onto a support having a plurality of the first surface primers immobilized thereon, under a condition suitable for hybridizing one or more portions of individual single stranded concatemers to one or more immobilized first surface primers (FIG. 39). In some embodiments, the immobilized first surface primers have terminal 3' group that are non-extendible. In some embodiments, the 3' terminal end of the immobilized first surface primers comprise a moiety that blocks primer extension, such as for example a phosphate group, a dideoxycytidine group, an inverted dT, or an amino group. In some embodiments, the immobilized first surface primer have an extendible 3'OH end. In some embodiments, the immobilized first surface primers lack a nucleotide having a scissile moiety. The concatemers are immobilized to the support by hybridization to the immobilized first surface primers. In some embodiments, the support comprises a plurality of first surface primers. In some embodiments, the support lacks a plurality of second surface primers. In some embodiments, the support comprises a plurality of first and second surface primers.

Figure 40:
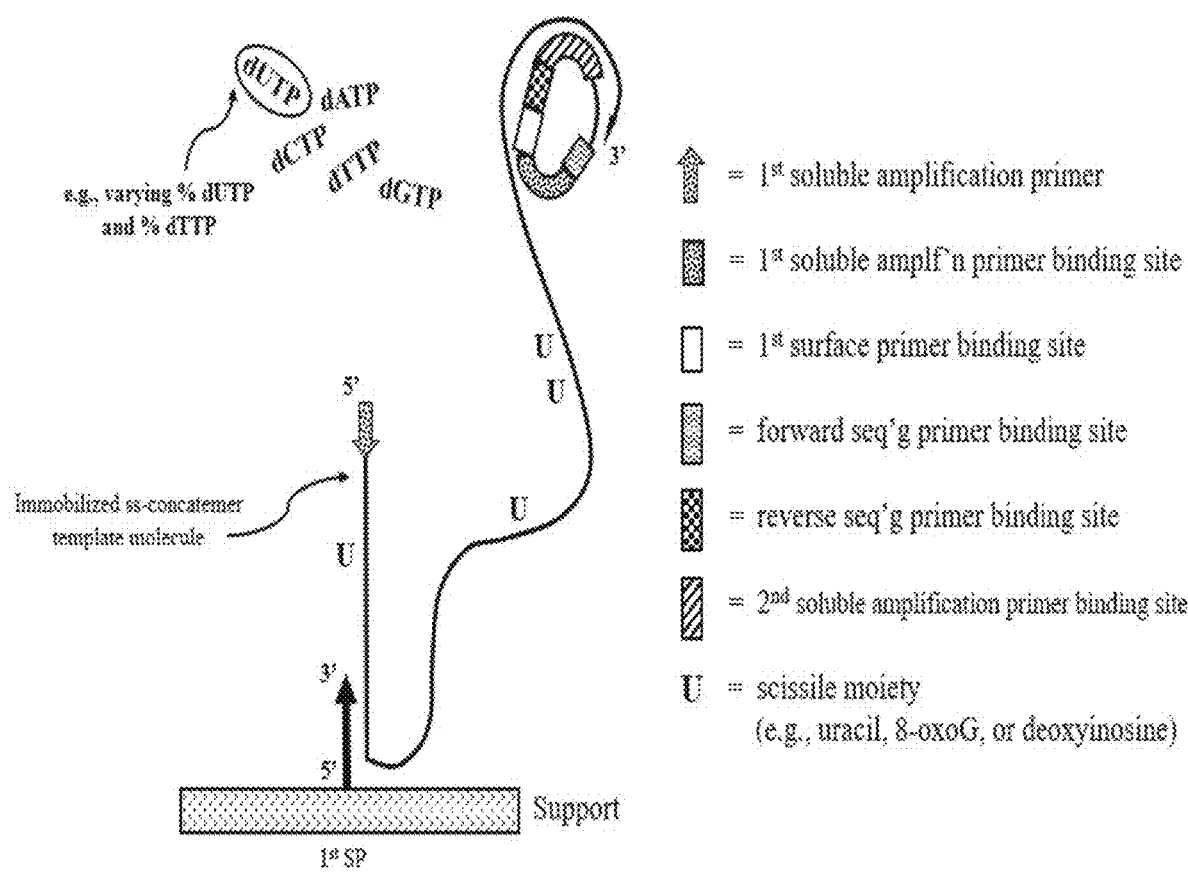

In some embodiments, the pairwise sequencing method further comprises step (c): continuing the rolling circle amplification reaction on the support to generate a plurality of extended concatemer template molecules that are immobilized via hybridization to the immobilized first surface primers (FIG. 40). The on-support RCA reaction can be conducted with a plurality of a strand displacing polymerase, and a plurality of nucleotides which include dATP, dCTP, dGTP, dTTP and a nucleotide having a scissile moiety, under a condition suitable to generate a plurality of extended concatemers having at least one nucleotide with a scissile moiety (FIG. 41). In some embodiments, the rolling circle amplification reaction on the support can be conducted in the presence, or in the absence, of a plurality of compaction oligonucleotides.

In some embodiments, the on-support rolling circle amplification reaction generates immobilized concatemer template molecules with incorporated nucleotides having a scissile moiety that are distributed at random positions along individual immobilized concatemer template molecules. In some embodiments, the nucleotides having a scissile moiety are distributed at different positions in the different immobilized concatemer template molecules.

In some embodiments, the immobilized first surface primers comprise single stranded oligonucleotides comprising DNA, RNA or a combination of DNA and RNA. The first surface primers comprise a sequence that is wholly complementary or partially complementary along their lengths to at least a portion of the concatemer molecules. In some embodiments, the first surface primers can lack a terminal 3' OH extendible end which renders the first surface primers non-extendible. In some embodiments, the first surface primers include a terminal 3' OH group which is extendible for nucleotide polymerization (e.g., polymerase catalyzed polymerization). The immobilized first surface primers can be immobilized to the support or immobilized to a coating on the support. The immobilized first surface primers can be embedded and attached (coupled) to the coating on the support. In some embodiments, the 5' end of the immobilized first surface primers are immobilized to a support or immobilized to a coating on the support. Alternatively, an interior portion or the 3' end of the immobilized first surface primers can be immobilized to a support or immobilized to a coating on the support. The support comprises a plurality of immobilized first surface primers having the same sequence. The immobilized first surface primers can be any length, for example 4-50 nucleotides, or 50-100 nucleotides, or 100-150 nucleotides, or longer lengths.

In some embodiments, the plurality of immobilized first surface primers comprise 3' extendible ends. In some embodiments, the 3' terminal end of the immobilized first surface primers comprise a moiety that blocks primer extension, such as for example a phosphate group, a dideoxycytidine group, an inverted dT, or an amino group. In some embodiments, the immobilized first surface primers are not extendible in a primer extension reaction. The immobilized first surface primers lack a nucleotide having a scissile moiety.

In some embodiments, the plurality of immobilized first surface primers comprise at least one phosphorothioate diester bond at their 5' ends which can render the first surface primers resistant to exonuclease degradation. In some embodiments, the plurality of immobilized first surface primers comprise 2-5 or more consecutive phosphorothioate diester bonds at their 5' ends. In some embodiments, the plurality of immobilized first surface primers comprise at least one ribonucleotide and/or at least one 2'-O-methyl or 2'-O-methoxyethyl (MOE) nucleotide which can render the first surface primers resistant to exonuclease degradation.

In some embodiments, the immobilized first surface primers comprise at least one locked nucleic acid (LNA) which comprises a methylene bridge bond between a 2' oxygen and 4' carbon of the pentose ring. Immobilized first surface primers that include at least one LNA can be resistant to nuclease digestions and can exhibit increased melting temperature when hybridized to the concatemer template molecules.

In some embodiments, the support further comprises a plurality of a second surface primer immobilized thereon (FIG. 52). The second surface primers have a sequence that differs from the first immobilized surface primer. The immobilized second surface primers comprise single stranded oligonucleotides comprising DNA, RNA or a combination of DNA and RNA. The second surface primers comprise a sequence that is wholly complementary or partially complementary along their lengths to at least a portion of a concatemer molecule. The immobilized second surface primers can be immobilized to the support or immobilized to a coating on the support. The immobilized second surface primers can be embedded and attached (coupled) to the coating on the support. In some embodiments, the 5' end of the immobilized second surface primers are immobilized to a support or immobilized to a coating on the support. Alternatively, an interior portion or the 3' end of the immobilized second surface primers can be immobilized to a support or immobilized to a coating on the support. The support comprises a plurality of immobilized second surface primers having the same sequence. The immobilized second surface primers can be any length, for example 4-50 nucleotides, or 50-100 nucleotides, or 100-150 nucleotides, or longer lengths.

In some embodiments, the 3' terminal end of the immobilized second surface primers comprise an extendible 3' OH moiety. In some embodiments, the 3' terminal end of the immobilized second surface primers comprise a 3' non-extendible moiety. The 3' terminal end of the immobilized second surface primers comprise a moiety that blocks primer extension, such as for example a phosphate group, a dideoxycytidine group, an inverted dT, or an amino group. The immobilized second surface primers are not extendible in a primer extension reaction. The immobilized second surface primers lack a nucleotide having a scissile moiety.

In some embodiments, the plurality of immobilized second surface primers comprise at least one phosphorothioate diester bond at their 5' ends which can render the second surface primers resistant to exonuclease degradation. In some embodiments, the plurality of immobilized second surface primers comprise 2-5 or more consecutive phosphorothioate diester bonds at their 5' ends. In some embodiments, the plurality of immobilized second surface primers comprise at least one ribonucleotide and/or at least one 2'-O-methyl or 2'-O-methoxyethyl (MOE) nucleotide which can render the second surface primers resistant to exonuclease degradation.

In some embodiments, individual immobilized single stranded nucleic acid concatemer template molecule are hybridized to an immobilized first surface primer, and at least one portion of the individual concatemer template molecule is hybridized to an immobilized second surface primer (FIG. 52). The immobilized second surface primers serve to pin down a portion of the immobilized concatemer template molecules to the support. The immobilized concatemer template molecule has two or more copies of a universal binding sequence for an immobilized second surface primer. The portion of the immobilized concatemer template molecule that includes the universal binding sequence for an immobilized second surface primer can hybridize to the immobilized second surface primer. In some embodiments, the second surface primers include a terminal 3' blocking group that renders them non-extendible. In some embodiments, the second surface primers have terminal 3' extendible ends.

In some embodiments, the support comprises about $10^2$-$10^{15}$ immobilized first surface primers per mm$^2$. In some embodiments, the support comprises about $10^2$-$10^{15}$ immobilized second surface primers per mm$^2$. In some embodiments, the support comprises about $10^2$-$10^{15}$ immobilized first surface primers and immobilized second surface primers per mm$^2$.

The immobilized surface primers (e.g., first and second surface primers) are in fluid communication with each other to permit flowing various solutions of linear or circular nucleic acid template molecules, soluble primers, enzymes, nucleotides, divalent cations, buffers, reagents, and the like, onto the support so that the plurality of immobilized surface primers react with the solutions in a massively parallel manner.

Figure 42:
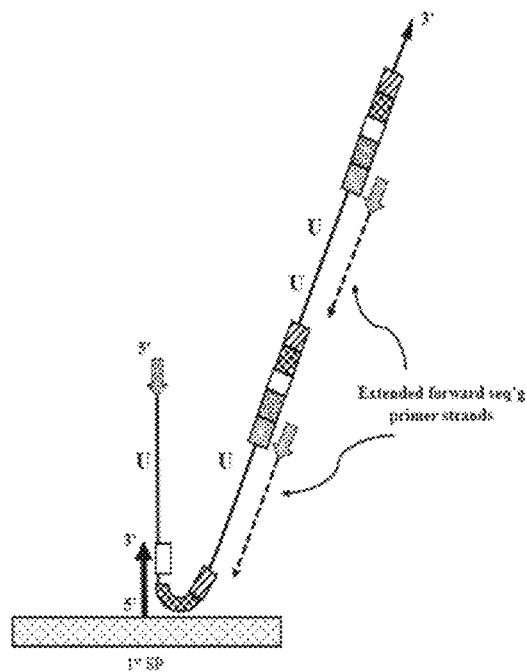

In some embodiments, the pairwise sequencing method further comprises step (d): sequencing the plurality of immobilized concatemer template molecules thereby generating a plurality of extended forward sequencing primer strands. The sequencing of step (d) comprises contacting the plurality of immobilized concatemer template molecules with a plurality of soluble forward sequencing primers under a condition suitable to hybridize at least one forward sequencing primer to at least one of the forward sequencing primer binding sites/sequences of the immobilized concatemer template molecules, and conducting forward sequencing reactions using one or more types of sequencing polymerases, a plurality of nucleotides and/or multivalent molecules, and the hybridized first forward sequencing primers. In some embodiments, the soluble forward sequencing primers comprise 3' OH extendible ends. In some embodiments, the soluble forward sequencing primers comprise a 3' blocking moiety which can be removed to generate a 3' OH extendible end. In some embodiments, the soluble forward sequencing primers lack a nucleotide having a scissile moiety. The forward sequencing reactions can generate a plurality of extended forward sequencing primer strands (FIG. 42). In some embodiments, individual immobilized concatemer template molecules have multiple copies of the forward sequencing primer binding sites, wherein each forward sequencing primer binding site is capable of hybridizing to a first forward sequencing primer. Individual forward sequencing primer binding sites in a given immobilized concatemer template molecule can be hybridized to a forward sequencing primer and can undergo a sequencing reaction. Individual immobilized concatemer template molecules can undergo two or more sequence reactions, where each sequencing reaction is initiated from a first forward sequencing primer that is hybridized to a forward sequencing primer binding site (e.g., see FIG. 42). In some embodiments, the sequencing reactions comprise a plurality of nucleotides (or analogs thereof) labeled with a detectable reporter moiety. In some embodiments, the sequencing reaction comprise a plurality of multivalent molecules having a plurality of nucleotide units attached to a core, where the multivalent molecules are labeled with a detectable reporter moiety. In some embodiments, the core is labeled with a detectable reporter moiety. In some embodiments, at least one linker and/or at least one nucleotide unit of a nucleotide arm is labeled with a detectable reporter moiety. In some embodiments, the detectable reporter moiety comprises a fluorophore. An exemplary nucleotide arm is shown in FIG. 108, and exemplary multivalent molecules are shown in FIGS. 104-107.

In some embodiments, the sequencing polymerases of step (d) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (d) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

In some embodiments, the pairwise sequencing method further comprises step (e): retaining the plurality of immobilized concatemer template molecules and replacing the plurality of extended forward sequencing primer strands with a plurality of forward extension strands that are hybridized to the retained immobilized single stranded nucleic acid concatemer template molecules. The plurality of extended forward sequencing primer strands can be removed and replaced with a plurality of forward extension strands by conducting a primer extension reaction (See FIGS. 43-45).

In some embodiments, step (e) comprises contacting at least one extended forward sequencing primer strand with a plurality of strand displacing polymerases and a plurality of nucleotides and in the absence of soluble amplification primers, under a condition suitable to conduct a strand displacing primer extension reaction using the at least one extended forward sequencing primers strand to initiate the primer extension reaction thereby generating a forward extension strand that is covalently joined to the extended forward sequencing primers strand, wherein the forward extension strand is hybridized to the immobilized concatemer template molecule (FIG. 43). For example, one of the extended forward sequencing primer strands can serve as a primer for the strand displacing polymerase. The strand displacing polymerase can extend the extended forward sequencing primer strand, and displace downstream extended forward sequencing primer strands while synthesizing an extended strand that replaces the downstream extended forward sequencing primer strands. The newly extended strand is covalently joined to an extended forward sequencing primer strand. The immobilized concatemer template molecules are retained. The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine III). Inclusion of compaction oligonucleotides and/or hexamine (e.g., cobalt hexamine III) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 μm or smaller.

Examples of strand displacing polymerases include phi29 DNA polymerase, large fragment of Bst DNA polymerase, large fragment of Bsu DNA polymerase (exo-), Bca DNA polymerase (exo-), Klenow fragment of E. coli DNA polymerase, T5 polymerase, M-MuLV reverse transcriptase, HIV viral reverse transcriptase, Deep Vent® DNA polymerase and KOD DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio).

In some embodiments, step (e) comprises: (i) removing the plurality of extended forward sequencing primer strand while retaining the immobilized concatemer template molecules; and (ii) contacting the plurality of retained immobilized concatemer molecules with a plurality of soluble forward sequencing primers (e.g., a second plurality of soluble forward sequencing primers), a plurality of nucleotides (e.g., a second plurality of nucleotides) and a plurality of primer extension polymerases, under a condition suitable to hybridize the plurality of soluble forward sequencing primers to the plurality of retained immobilized concatemer template molecules and suitable for conducting polymerase-catalyzed primer extension reactions thereby generating a plurality of forward extension strands, wherein the soluble sequencing primers hybridize with the forward sequencing primer binding sequence in the retained immobilized concatemer molecules (FIG. 44). The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine III). Inclusion of compaction oligonucleotides and/or hexamine (e.g., cobalt hexamine III) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 μm or smaller.

In some embodiments, in step (e), the condition suitable to hybridize the plurality of soluble forward sequencing primers to the plurality of retained immobilized single stranded nucleic acid concatemer template molecules comprises hybridizing retained immobilized concatemer template molecules with the soluble primers in the presence of a primer extension polymerase, a plurality of nucleotides, and a high efficiency hybridization buffer. In some embodiment, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10/a by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, step (e) comprises: (i) removing the plurality of extended forward sequencing primer strand while retaining the immobilized concatemer template molecules; and (ii) contacting the plurality of retained immobilized concatemer molecules with a plurality of soluble amplification primers, a plurality of nucleotides (e.g., a second plurality of nucleotides) and a plurality of primer extension polymerases, under a condition suitable to hybridize the plurality of soluble amplification primers to the plurality of retained immobilized concatemer template molecules and suitable for conducting polymerase-catalyzed primer extension reactions thereby generating a plurality of forward extension strands, wherein the soluble amplification primers hybridize with the soluble amplification primer binding sequence in the retained immobilized concatemer molecules (FIG. 45). The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine III). Inclusion of compaction oligonucleotides and/or hexamine (e.g., cobalt hexamine III) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 μm or smaller.

In some embodiments, in step (e), the condition suitable to hybridize the plurality of soluble amplification primers to the plurality of retained immobilized single stranded nucleic acid concatemer template molecules comprises hybridizing retained immobilized concatemer template molecules with the soluble primers in the presence of a primer extension polymerase, a plurality of nucleotides, and a high efficiency hybridization buffer. In some embodiment, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, in step (e), the plurality of extended forward sequencing primer strands can be removed using an enzyme or a chemical reagent. For example, the plurality of extended forward sequencing primer strands can be enzymatically degraded using a 5' to 3' double-stranded DNA exonuclease, including T7 exonuclease (e.g., from New England Biolabs, catalog #M0263S). In some embodiments, the plurality of extended forward sequencing primer strands can be removed with a temperature that favors nucleic acid denaturation.

In some embodiments, in step (e), a denaturation reagent can be used to remove the plurality of extended forward sequencing primer strands, wherein the denaturation reagent comprises any one or any combination of compounds such as formamide, acetonitrile, guanidinium chloride and/or a buffering agent (e.g., Tris-HCl, MES, HEPES, or the like).

In some embodiments, in step (e), the plurality of extended forward sequencing primer strands can be removed using an elevated temperature (e.g., heat) with or without a nucleic acid denaturation reagent. The plurality of extended forward sequencing primer strands can be subjected to a temperature of about 45-50° C., or about 50-60° C., or about 60-70° C., or about 70-80° C., or about 80-90° C., or about 90-95° C., or higher temperature.

In some embodiments, in step (e), the plurality of extended forward sequencing primer strands can be removed using 100% formamide at a temperature of about 65° C. for about 3 minutes, and washing with a reagent comprising about 50 mM NaCl or equivalent ionic strength and having a pH of about 6.5-8.5.

In some embodiments, the primer extension polymerase of step (e) comprises a high fidelity polymerase. In some embodiments, the primer extension polymerase of step (e)

comprises a DNA polymerase capable of catalyzing a primer extension reaction using a uracil-containing template molecule (e.g., a uracil-tolerant polymerase). Exemplary polymerases include, but are not limited to, Q5U® Hot Start high-fidelity DNA polymerase (e.g., catalog #M0515S from New England Biolabs), Taq DNA polymerase, OneTaq® DNA polymerase (e.g., mixture of Taq and Deep Vent® DNA polymerases, catalog #M0480S from New England Biolabs), LongAmp® Taq DNA polymerase (e.g., catalog #M0323S from New England Biolabs), EpiMark® Hot Start Taq DNA polymerase (e.g., catalog #M0490S from New England Biolabs), Bst DNA polymerase (e.g., large fragment, catalog #M0275S from New England Biolabs), Bsu DNA polymerase (e.g., large fragment, catalog #M0330S from New England Biolabs), Phi29 DNA polymerase (e.g., catalog #M0269S from New England Biolabs), E. coli DNA polymerase (e.g., catalog #M0209S from New England Biolabs), Therminator™ DNA polymerase (e.g., catalog #M0261S from New England Biolabs), Vent® DNA polymerase and Deep Vent® DNA polymerase.

The pairwise methods described herein can provide increased accuracy in a downstream sequencing reaction because step (e) replaces the extended forward sequencing primer strands that were generated in step (d) with forward extension strands having reduced base errors. The extended forward sequencing primer strands are generated in step (d) and may or may not contain erroneously incorporated nucleotides due to polymerase-catalyzed mis-paired bases. When step (e) is conducted with a high fidelity DNA polymerase, the resulting forward extension strands may have reduced base errors compared to the extended forward sequencing primer strands. The forward extension strands will be used as a nucleic acid template for a downstream sequencing step (e.g., see step (f) below). Thus, step (e) can increase the sequencing accuracy of the downstream step (g) and therefore increase the overall sequencing accuracy of the pairwise sequencing workflow.

In some embodiments, the pairwise sequencing method further comprises step (f): removing the retained immobilized concatemer template molecules by generating abasic sites in the immobilized single stranded concatemer template molecules at the nucleotide(s) having the scissile moiety and generating gaps at the abasic sites to generate a plurality of gap-containing single stranded nucleic acid concatemer template molecules while retaining the plurality of forward extension strands and retaining the plurality of immobilized surface primers (FIGS. 46 and 48).

The abasic sites are generated on the retained concatemer template strands that contain nucleotides having scissile moieties. In some embodiments, the scissile moieties in the retained concatemer template molecules comprises uridine, 8-oxo-7,8-dihydroguanine (e.g., 8oxoG) or deoxyinosine. The abasic sites can be removed to generate a plurality of single stranded nucleic acid template molecules having gaps while retaining the plurality of forward extension strands. The abasic sites can be generated by contacting the immobilized concatemer template molecules with an enzyme that removes the nucleo-base at the nucleotide having the scissile moiety. The uracil in the retained concatemer template strands can be converted to an abasic site using uracil DNA glycosylase (UDG). The 8oxoG in the retained concatemer template strands can be converted to an abasic site using FPG glycosylase. The deoxyinosine in the retained concatemer template strands can be converted to an abasic site using AlkA glycosylase.

In some embodiments, in step (f), the gaps can be generated by contacting the abasic sites in the immobilized concatemer template molecules with an enzyme or a mixture of enzymes having lyase activity that breaks the phosphodiester backbone at the 5' and 3' sides of the abasic site to release the base-free deoxyribose and generate a gap (FIGS. 46 and 48). The abasic sites can be removed using AP lyase, Endo IV endonuclease, FPG glycosylase/AP lyase, Endo VIII glycosylase/AP lyase. In some embodiments, generating the abasic sites and removal of the abasic sites to generate gaps can be achieved using a mixture of uracil DNA glycosylase and DNA glycosylase-lyase endonuclease VIII, for example USER™ (Uracil-Specific Excision Reagent Enzyme from New England Biolabs) or thermolabile USER (also from New England Biolabs).

In some embodiments, in step (f), the plurality of gap-containing template molecules can be removed using an enzyme, chemical compound and/or heat. After the gap-removal procedure, the plurality of retained forward extension strands can be hybridized to the retained immobilized surface primers (FIGS. 47 and 49).

For example, the plurality of gap-containing template molecules can be enzymatically degraded using a 5' to 3' double-stranded DNA exonuclease, including T7 exonuclease (e.g., from New England Biolabs, catalog #M0263S). When a 5' to 3' double-stranded DNA exonuclease is used for removing gap-containing template molecules, then the plurality of soluble amplification primers in step (e) can comprise at least one phosphorothioate diester bond at their 5' ends which can render the soluble amplification primers resistant to exonuclease degradation. In some embodiments, the plurality of soluble amplification primers in step (e) comprise 2-5 or more consecutive phosphorothioate diester bonds at their 5' ends. In some embodiments, the plurality soluble amplification primers in step (e) comprise at least one ribonucleotide and/or at least one 2'-O-methyl or 2'-O-methoxyethyl (MOE) nucleotide which can render the forward sequencing primers resistant to exonuclease degradation.

In some embodiments, the plurality of gap-containing template molecules can be removed using a chemical reagent that favors nucleic acid denaturation. The denaturation reagent can include any one or any combination of compounds such as formamide, acetonitrile, guanidinium chloride and/or a buffering agent (e.g., Tris-HCl, MES, HEPES, or the like).

In some embodiments, the plurality of gap-containing template molecules can be removed using an elevated temperature (e.g., heat) with or without a nucleic acid denaturation reagent. The gap-containing template molecules can be subjected to a temperature of about 45-50° C., or about 50-60° C., or about 60-70° C., or about 70-80° C., or about 80-90° C., or about 90-95° C., or higher temperature.

In some embodiments, the plurality of gap-containing template molecules can be removed using 100% formamide at a temperature of about 65° C. for about 3 minutes, and washing with a reagent comprising about 50 mM NaCl or equivalent ionic strength and having a pH of about 6.5-8.5.

In some embodiments, the pairwise sequencing method further comprises step (g): sequencing the plurality of retained forward extension strands thereby generating a plurality of extended reverse sequencing primer strands. In some embodiments, the sequencing of step (g) comprises contacting the plurality of retained forward extension strands with a plurality of soluble reverse sequencing primers under a condition suitable to hybridize the reverse sequencing primers to the reverse sequencing primer binding site of the retained forward extension strands, and by conducting sequencing reactions using the hybridized reverse sequencing primers wherein the forward sequencing reactions generates a plurality of extended reverse sequencing primer strands (FIGS. 50 and 51). The extended reverse sequencing primer strands are hybridized to the retained forward extension strand. The retained forward extension strand is hybridized to the first surface primer. The extended reverse sequencing primer strands are not hybridized to the first surface primer, or covalently joined to the first surface primer. Therefore, the extended reverse sequencing primer strands are not immobilized to the support.

For the sake of simplicity, FIGS. 47 and 49 show exemplary retained forward extension strands each having either (i) one copy of the sequence of interest and various universal primer binding sites (FIG. 47) or (ii) two tandem copies of the sequence of interest and various universal primer binding sites (FIG. 49). The skilled artisan will appreciate that the retained forward extension strand can include two, three, four or many more tandem copies containing the sequence of interest and various universal primer binding sites. Therefore, the reverse sequencing reaction can generate a plurality of extended reverse sequencing primer strands hybridized to the same retained forward extension strand.

In some embodiments, in step (g), the condition suitable to hybridize the reverse sequencing primers to the reverse sequencing primer binding sequences of the retained forward extension strands comprises contacting the plurality of soluble reverse sequencing primers and the retained forward extension strands with a high efficiency hybridization buffer. In some embodiments, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In an alternative embodiment, the sequencing of step (g) comprises using the immobilized surface primer as a sequencing primer and conducting sequencing reactions to generate a plurality of reverse sequencing strands.

In some embodiments, the reverse sequencing reactions of step (g) comprises contacting the plurality of reverse sequencing primers with the reverse sequencing primer binding sequences of the retained forward extension strands, one or more types of sequencing polymerases, and a plurality of nucleotides and/or a plurality of multivalent molecules. In some embodiments, the soluble reverse sequencing primers comprise 3' OH extendible ends. In some embodiments, the soluble reverse sequencing primers comprise a 3' blocking moiety which can be removed to generate a 3' OH extendible end. In some embodiments, the soluble reverse sequencing primers lack a nucleotide having a scissile moiety. The sequencing reactions that employ nucleotides and/or multivalent molecules is described in more detail below. The reverse sequencing reactions can generate a plurality of extended reverse sequencing primer strands. In some embodiments, individual retained forward extension strands have multiple copies of the reverse sequencing primer binding sequences/sites, wherein each reverse sequencing primer binding site is capable of hybridizing to a reverse sequencing primer. Individual reverse sequencing primer binding sites in a given retained forward extension strand can be hybridized to a reverse sequencing primer and can undergo a sequencing reaction. Thus, an individual retained forward extension strand can undergo two or more sequence reactions, where each sequencing reaction is initiated from a reverse sequencing primer that is hybridized to a reverse sequencing primer binding site (FIGS. 50 and 51). In some embodiments, the sequencing reactions comprise a plurality of nucleotides (or analogs thereof) labeled with a detectable reporter moiety. In some embodiments, the sequencing reaction comprise a plurality of multivalent molecules having nucleotide units, where the multivalent molecules are labeled with a detectable reporter moiety. In some embodiments, the detectable reporter moiety comprises a fluorophore.

In some embodiments, the sequencing polymerases of step (g) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (g) comprise engineered polymerases comprising at least 70%, 75%, 80%, 85%, 90%, 91%, 92%, 93%, 94%, 95%, 96%, 97%, 98%, 99%, or greater than 99%, sequence identity to any of SEQ ID NOS: 3-1315, 1317-2214, 2216-2366, 2368-2392, 2394-2407, 2409-2435, 2437-2454, 2456-2501 or 2511-2523.

In some embodiments, at least one washing step can be conducted after any of steps (a)-(g). The washing step can be conducted with a wash buffer comprising a pH buffering agent, a metal chelating agent, a salt, and a detergent.

In some embodiments, the pH buffering compound in the wash buffer comprises any one or any combination of two or more of Tris, Tris-HCl, Tricine, Bicine, Bis-Tris propane, HEPES, MES, MOPS, MOPSO, BES, TES, CAPS, TAPS, TAPSO, ACES, PIPES, ethanolamine (a.k.a 2-amino methanol; MEA), a citrate compound, a citrate mixture, NaOH and/or KOH. In some embodiments, the pH buffering agent can be present in the wash buffer at a concentration of about 1-100 mM, or about 10-50 mM, or about 10-25 mM. In some embodiments, the pH of the pH buffering agent which is present in any of the reagents described here in can be adjusted to a pH of about 4-9, or a pH of about 5-9, or a pH of about 5-8.

In some embodiments, the metal chelating agent in the wash buffer comprises EDTA (ethylenediaminetetraacetic acid), EGTA (ethylene glycol tetraacetic acid), HEDTA (hydroxyethylethylenediaminetriacetic acid), DPTA (diethylene triamine pentaacetic acid), NTA (N,N-bis(carboxymethyl)glycine), citrate anhydrous, sodium citrate, calcium citrate, ammonium citrate, ammonium bicitrate, citric acid, potassium citrate, or magnesium citrate. In some embodiments, the wash buffer comprises a chelating agent at a concentration of about 0.01-50 mM, or about 0.1-20 mM, or about 0.2-10 mM.

In some embodiments, the salt in the wash buffer comprises NaCl, KCl, $NH_2SO_4$ or potassium glutamate. In some embodiments, the detergent comprises an ionic detergent such as SDS (sodium dodecyl sulfate). The wash buffer can include a monovalent salt at a concentration of about 25-500 mM, or about 50-250 mM, or about 100-200 mM.

In some embodiments, the detergent in the wash buffer comprises a non-ionic detergent such as Triton X-100, Tween 20, Tween 80 or Nonidet P-40. In some embodiments, the detergent comprises a zwitterionic detergent such as CHAPS (3-[(3-cholamidopropyl)dimethylammonio]-1-propanesulfonate) or N-Dodecyl-N,N-dimethyl-3-amonio-1-propanesulfate (DetX). In some embodiments, the detergent comprises LDS (lithium dodecyl sulfate), sodium taurodeoxycholate, sodium taurocholate, sodium glycocholate, sodium deoxycholate or sodium cholate. In some embodiments, the detergent is included in the wash buffer at a concentration of about 0.01-0.05%, or about 0.05-0.1%, or about 0.1-0.15%, or about 0.15-0.2%, or about 0.2-0.25%.

On Support Ligation and RCA and Pairwise Sequencing

The present disclosure provides pairwise sequencing methods, comprising step (a): providing a support having a plurality of surface primers (e.g., a plurality of first surface primers) immobilized thereon, wherein individual first surface primers in the plurality comprise a first portion (SP1-A) and a second portion (SP1-B), and the individual first surface primers comprising a 3' extendible end and lacking a nucleotide having a scissile moiety that can be cleaved to generate an abasic site in the first surface primer. In some embodiments, the immobilized first surface primers lack a nucleotide having a scissile moiety (FIG. 55). For example, the surface primers lack uridine, 8-oxo-7,8-dihydroguanine (e.g., 8oxoG) and deoxyinosine. In some embodiments, the first and second portions (SP1-A and SP1-B) of the first surface primers have the same or different lengths. The first portion (SP1-A) of the first surface primers can be about 4-50 nucleotides, or 50-100 nucleotides, or 100-150 nucleotides, or longer lengths. The second portion (SP1-B) of the first surface primers can be about 4-50 nucleotides, or 50-100 nucleotides, or 100-150 nucleotides, or longer lengths. In some embodiments, the first and second portions (SP1-A and SP1-B) of the immobilized first surface primers have the same or different sequences. In some embodiments, the support comprises a plurality of first surface primers. In some embodiments, the support lacks a plurality of second surface primers. In some embodiments, the support comprises a plurality of first and second surface primers.

In some embodiments, the immobilized first surface primers comprise single stranded oligonucleotides comprising DNA, RNA or a combination of DNA and RNA. The first surface primers comprise a sequence that is wholly complementary or partially complementary along their lengths to at least a portion of a nucleic acid library molecule (e.g., linear or circular library molecules). The first surface primers can include a terminal 3' nucleotide having a sugar 3' OH moiety which is extendible for nucleotide polymerization (e.g., polymerase catalyzed polymerization).

The immobilized first surface primers can be immobilized to the support or immobilized to a coating on the support. The immobilized first surface primers can be embedded and attached (coupled) to the coating on the support. In some embodiments, the 5' end of the immobilized first surface primers are immobilized to a support or immobilized to a coating on the support. Alternatively, an interior portion or the 3' end of the immobilized first surface primers can be immobilized to a support or immobilized to a coating on the support. The support comprises a plurality of immobilized first surface primers having the same sequence. The immobilized first surface primers can be any length, for example 4-50 nucleotides, or 50-100 nucleotides, or 100-150 nucleotides, or longer lengths.

In some embodiments, the plurality of immobilized first surface primers comprise at least one phosphorothioate diester bond at their 5' ends which can render the first surface primers resistant to exonuclease degradation. In some embodiments, the plurality of immobilized first surface primers comprise 2-5 or more consecutive phosphorothioate diester bonds at their 5' ends. In some embodiments, the plurality of immobilized first surface primers comprise at least one ribonucleotide and/or at least one 2'-O-methyl or 2'-O-methoxyethyl (MOE) nucleotide which can render the first surface primers resistant to exonuclease degradation.

In some embodiments, the immobilized first surface primers comprise at least one locked nucleic acid (LNA) which comprises a methylene bridge bond between a 2' oxygen and 4' carbon of the pentose ring. Immobilized first surface primers that include at least one LNA can be resistant to nuclease digestions and can exhibit increased melting temperature when hybridized to the forward extension strand.

In some embodiments, the support further comprises a plurality of a second surface primer immobilized thereon (FIG. 72). The second surface primers have a sequence that differs from the first immobilized surface primer. The immobilized second surface primers of step (a) comprise single stranded oligonucleotides comprising DNA, RNA or a combination of DNA and RNA. The second surface primers comprise a sequence that is wholly complementary or partially complementary along their lengths to at least a portion of an immobilized single stranded concatemer template molecule. The immobilized second surface primers can be immobilized to the support or immobilized to a coating on the support. The immobilized second surface primers can be embedded and attached (coupled) to the coating on the support. In some embodiments, the 5' end of the immobilized second surface primers are immobilized to a support or immobilized to a coating on the support. Alternatively, an interior portion or the 3' end of the immobilized second surface primers can be immobilized to a support or immobilized to a coating on the support. The support comprises a plurality of immobilized second surface primers having the same sequence. The immobilized second surface primers can be any length, for example 4-50 nucleotides, or 50-100 nucleotides, or 100-150 nucleotides, or longer lengths. In some embodiments, the 3' terminal end of the immobilized second surface primers comprise an extendible 3' OH moiety. In some embodiments, the 3' terminal end of the immobilized second surface primers comprise a 3' non-extendible moiety. The 3' terminal end of the immobilized second surface primers comprise a moiety that blocks primer extension, such as for example a phosphate group, a dideoxycytidine group, an inverted dT, or an amino group. The immobilized second surface primers are not extendible in a primer extension reaction. The immobilized second surface primers lack a nucleotide having a scissile moiety.

In some embodiments, the plurality of immobilized second surface primers comprise at least one phosphorothioate diester bond at their 5' ends which can render the second surface primers resistant to exonuclease degradation. In some embodiments, the plurality of immobilized second surface primers comprise 2-5 or more consecutive phosphorothioate diester bonds at their 5' ends. In some embodiments, the plurality of immobilized second surface primers comprise at least one ribonucleotide and/or at least one 2'-O-methyl or 2'-O-methoxyethyl (MOE) nucleotide which can render the second surface primers resistant to exonuclease degradation.

In some embodiments, individual immobilized single stranded nucleic acid concatemer template molecule are covalently joined to an immobilized first surface primer, and at least one portion of the individual concatemer template molecule is hybridized to an immobilized second surface primer (FIG. 72). The immobilized second surface primers serve to pin down a portion of the immobilized concatemer template molecules to the support. The immobilized concatemer template molecule has two or more copies of a universal binding sequence for an immobilized second surface primer. The portion of the immobilized concatemer template molecule that includes the universal binding sequence for an immobilized second surface primer can hybridize to the immobilized second surface primer. In some embodiments, the second surface primers include a terminal 3' blocking group that renders them non-extendible. In some embodiments, the second surface primers have terminal 3' extendible ends.

In some embodiments, the support comprises about $10^2$-$10^{15}$ immobilized first surface primers per mm$^2$. In some embodiments, the support comprises about $10^2$-$10^{15}$ immobilized second surface primers per mm$^2$. In some embodiments, the support comprises about $10^2$-$10^{15}$ immobilized first surface primers and immobilized second surface primers per mm$^2$.

The immobilized surface primers (e.g., first and second surface primers) are in fluid communication with each other to permit flowing various solutions of linear or circular nucleic acid template molecules, soluble primers, enzymes, nucleotides, divalent cations, buffers, reagents, and the like, onto the support so that the plurality of immobilized surface primers (and the primer extension products generated from the immobilized surface primers) react with the solutions in a massively parallel manner.

In some embodiments, the pairwise sequencing method further comprises step (b): contacting the plurality of the first surface primers with a plurality of single stranded linear nucleic acid library molecules each library molecule having 5' and 3' ends. The contacting is conducted under a condition suitable for hybridizing individual library molecules to an immobilized first surface primer to form a circularized library molecule having a gap or nick between the 5' and 3' ends of the circularized library molecule (FIGS. 57 and 58).

In some embodiments, the position of the gap or nick in the circularized library molecules can be asymmetrical or symmetrical relative to the duplex formed by hybridizing the 5' and 3' ends of the linear library molecule to the immobilized first surface primers. For example, FIG. 57 shows an asymmetrical positioned gap or nick. FIG. 58 (left) shows an asymmetrical positioned gap or nick. FIG. 58 (right) shows a symmetrical positioned gap or nick. An asymmetrical or symmetrical positioned gap/nick can be generated by adjusting the length of the first portion (SP1-A) and the second portion (SP1-B) in the immobilized first surface primers.

In some embodiments, individual library molecules in the plurality comprise a sequence of interest and the library molecules further comprise any one or any combination of two or more of: (i) a universal binding sequence (or complementary sequence thereof) for a soluble forward sequencing primer; (ii) a universal binding sequence (or complementary sequence thereof) for a soluble reverse sequencing primer; (iii) a universal binding sequence (or complementary sequence thereof) for a first portion of an immobilized first surface primer (SP1-A); (iv) a universal binding sequence (or complementary sequence thereof) for a second portion of an immobilized first surface primer (SP1-B); (v) a universal binding sequence (or complementary sequence thereof) for an immobilized second surface primer; (vi) a universal binding sequence (or complementary sequence thereof) for a first soluble amplification primer; (vii) a universal binding sequence (or complementary sequence thereof) for a second soluble amplification primer; (viii) a universal binding sequence (or complementary sequence thereof) for a soluble compaction oligonucleotide; (ix) a sample barcode sequence and/or (x) a unique molecular index sequence. An exemplary single stranded linear library molecule is shown in FIG. 56.

In some embodiments, the universal binding sequence for a first portion of an immobilized first surface primer (e.g., SP1-A') in the linear library molecule can hybridize to the first portion of the immobilized first surface primer (SP1-A). In some embodiments, the universal binding sequence for a second portion of an immobilized first surface primer (e.g., SP1-B') in the linear library molecule can hybridize to the second portion of the immobilized first surface primer (SP1-B). In some embodiments, the immobilized first surface primers comprise a first portion (SP1-A) and a second portion (SP1-B) which hybridize to SP1-A' and SP1-B' in the linear library molecule, and the first surface primers serve as a nucleic acid splint molecule for circularizing the linear library molecules.

In some embodiments, the pairwise sequencing method further comprises step (c): enzymatically closing the gap or nick thereby forming individual single stranded covalently closed circular molecules that are hybridized to an immobilized first surface primer (FIG. 59, FIG. 60 (left) and FIG. 60 (right)).

In some embodiments, the gap in the circularized library molecule is closed by conducting a polymerase-catalyzed gap fill-in reaction using the 3' extendible end of the library molecule as an initiation site for the polymerase-catalyzed fill-in reaction and using the immobilized first surface primer as a template molecule thereby forming circularized molecule having a nick. The nick is closed by conducting an enzymatic ligation reaction to form a single stranded covalently closed circular molecule, wherein individual covalently closed circular molecules are hybridized to an immobilized first surface primer. In some embodiments, the gap fill-in reaction can be conducting with a plurality of nucleotides and a polymerase that lacks 5' to 3' strand displacement activity. The polymerase comprises *E. coli* DNA polymerase I, Klenow fragment of *E. coli* DNA polymerase I, T7 DNA polymerase, or T4 DNA polymerase. In some embodiments, the ligation reaction can be conducted using a DNA ligase which comprises a T3, T4, T7 or Taq DNA ligase.

In some embodiments, the nick in the circularized library molecule is closed by conducting a ligase-catalyzed ligation reaction to form a single stranded covalently closed circular molecule, wherein individual covalently closed circular molecules are hybridized to an immobilized first surface primer. In some embodiments, the ligase enzyme comprises T3, T4, T7 or Taq DNA ligase.

In some embodiments, the pairwise sequencing method further comprises step (d): generating a plurality of immobilized single stranded nucleic acid concatemer template molecules by conducting a rolling circle amplification reaction with a plurality of a strand displacing polymerase, and a plurality of nucleotides which include dATP, dCTP, dGTP, dTTP and a nucleotide having a scissile moiety that can be cleaved to generate an abasic site, thereby generating a plurality of immobilized single stranded nucleic acid concatemer template molecules having at least one nucleotide with a scissile moiety, wherein individual single stranded nucleic acid concatemer template molecules are covalently joined to an immobilized first surface primer (FIG. 61). In some embodiments, the rolling circle amplification reaction can be conducted in the presence, or in the absence, of a plurality of a plurality of compaction oligonucleotides.

In some embodiments, the single-stranded circular nucleic acid library molecules can be removed from the concatemer template molecules with at least one washing step which is conducted under a condition suitable to retain the single stranded nucleic acid concatemer template molecules where individual concatemer template molecules are operably joined to an immobilized first surface primer.

In some embodiments, individual immobilized concatemer template molecules generated by the rolling circle amplification reaction comprise two or more copies of a sequence of interest and wherein the individual immobilized concatemer template molecules further comprise any one or any combination of two or more of: (i) two or more copies of a universal binding sequence for a soluble forward sequencing primer; (ii) two or more copies of a universal binding sequence for a soluble reverse sequencing primer; (iii) two or more copies of a universal binding sequence for a first portion of an immobilized first surface primer (SP1-A); (iv) two or more copies of a universal binding sequence for a second portion of an immobilized first surface primer (SP1-B); (v) two or more copies of a universal binding sequence for an immobilized second surface primer; (vi) two or more copies of a universal binding sequence for a first soluble amplification primer (vii) two or more copies of a universal binding sequence for a second soluble amplification primer; (viii) two or more copies of a universal binding sequence for a soluble compaction oligonucleotide; (ix) two or more copies of a sample barcode sequence and/or (x) two or more copies of a unique molecular index sequence.

In some embodiments, the plurality of immobilized single stranded nucleic acid concatemer template molecules that are generated by the rolling circle amplification reaction of step (d) further comprise two or more copies of a universal binding sequence (or complementary sequence thereof) for immobilized second sequence surface primers. In some embodiments, individual immobilized single stranded nucleic acid concatemer template molecule are joined (e.g., covalently joined) to an immobilized first surface primer, and at least one portion of the individual concatemer template molecule is hybridized to an immobilized second surface primer. The immobilized second surface primers serve to pin down a portion of the immobilized concatemer template molecules to the support (see FIG. 72). In some embodiments, the second surface primers include a terminal 3' blocking group that renders them non-extendible.

The rolling circle amplification reaction of step (d) can be conducted with a nucleotide mixture containing dATP, dCTP, dGTP, dTTP and a nucleotide having a scissile moiety to generate immobilized concatemer template molecules which includes at least one nucleotide having a scissile moiety. The scissile moieties in the immobilized concatemer template molecules can be converted into abasic sites. In some embodiments, in the nucleotide mixture, the nucleotide having the scissile moiety comprises uridine, 8-oxo-7,8-dihydroguanine (e.g., 8oxoG) or deoxyinosine. In the immobilized concatemer template molecules, the uridine can be converted to an abasic site using uracil DNA glycosylase (UDG), the 8oxoG can be converted to an abasic site using FPG glycosylase, and the deoxyinosine can be converted to an abasic site using AlkA glycosylase.

In some embodiments, the nucleotide mixture can include an amount of dUTP so that a target percent of the thymidine in the resulting concatemer molecules are replaced with dUTP. For example, when 30% of dTTP in the concatemer molecules are to be replaced with dUTP (e.g., 30% is the target percent) then the nucleotide mixture can contain 7.5% dUTP (e.g., 30/4=7.5%), 17.5% dTTP, and 25% each for dATP, dCTP and dGTP. The target percent of dTTP to be replaced by dUTP can be about 0.1-1%, or about 1-5%, or about 5-10%, or about 10-20%, or about 20-30%, or about 30-45%, or about 45-50%, or a higher percent of the dTTP in the immobilized concatemer template molecules are replaced with nucleotides having a scissile moiety.

In some embodiments, the nucleotide mixture can include an amount of deoxyinosine so that a target percent of the guanosine in the resulting concatemer molecules are replaced with deoxyinosine. For example, when 30% of dGTP in the concatemer molecules are to be replaced with deoxyinosine (e.g., 30% is the target percent) then the nucleotide mixture can contain 7.5% deoxyinosine (e.g., 30/4=7.5%), 17.5% dGTP, and 25% each for dATP, dCTP and dTTP. The target percent of dGTP to be replaced by deoxyinosine can be about 0.1-1%, or about 1-5%, or about 5-10%, or about 10-20%, or about 20-30%, or about 30-45%, or about 45-50%, or a higher percent of the dGTP in the immobilized concatemer template molecules are replaced with nucleotides having a scissile moiety.

In some embodiments, the nucleotide mixture can include an amount of 8oxoG so that a target percent of the guanosine in the resulting concatemer molecules are replaced with 8oxoG. For example, when 30% of dGTP in the concatemer molecules are to be replaced with 8oxoG (e.g., 30% is the target percent) then the nucleotide mixture can contain 7.5% 8oxoG (e.g., 30/4=7.5%), 17.5% dGTP, and 25% each for dATP, dCTP and dTTP. The target percent of dGTP to be replaced by 8oxoG can be about 0.1-1%, or about 1-5%, or about 5-10%, or about 10-20%, or about 20-30%, or about 30-45%, or about 45-50%, or a higher percent of the dGTP in the immobilized concatemer template molecules are replaced with nucleotides having a scissile moiety.

In some embodiments, the rolling circle amplification reaction generates immobilized concatemer template molecules with incorporated nucleotides having a scissile moiety that are distributed at random positions along individual immobilized concatemer template molecules. In some embodiments, the nucleotides having a scissile moiety are distributed at different positions in the different immobilized concatemer template molecules.

In some embodiments, the pairwise sequencing method further comprises step (e): sequencing the plurality of immobilized concatemer template molecules thereby generating a plurality of extended forward sequencing primer strands. The sequencing of step (e) comprises contacting the plurality of immobilized concatemer template molecules with a plurality of soluble forward sequencing primers under a condition suitable to hybridize at least one forward sequencing primer to at least one of the forward sequencing primer binding sites/sequences of the immobilized concatemer template molecules, and conducting forward sequencing reactions using one or more types of sequencing polymerases, a plurality of nucleotides and/or multivalent molecules, and the hybridized first forward sequencing primers (FIG. 62). In some embodiments, the soluble forward sequencing primers comprise 3' OH extendible ends. In some embodiments, the soluble forward sequencing primers comprise a 3' blocking moiety which can be removed to generate a 3' OH extendible end. In some embodiments, the soluble forward sequencing primers lack a nucleotide having a scissile moiety. The forward sequencing reactions can generate a plurality of extended forward sequencing primer strands. In some embodiments, individual immobilized concatemer template molecules have multiple copies of the forward sequencing primer binding sites, wherein each forward sequencing primer binding site is capable of hybridizing to a first forward sequencing primer. Individual forward sequencing primer binding sites in a given immobilized concatemer template molecule can be hybridized to a forward sequencing primer and can undergo a sequencing reaction. Individual immobilized concatemer template molecules can undergo two or more sequence reactions, where each sequencing reaction is initiated from a first forward sequencing primer that is hybridized to a forward sequencing primer binding site (e.g., see FIG. 62). In some embodiments, the sequencing reactions comprise a plurality of nucleotides (or analogs thereof) labeled with a detectable reporter moiety. In some embodiments, the sequencing reaction comprise a plurality of multivalent molecules having a plurality of nucleotide units attached to a core, where the multivalent molecules are labeled with a detectable reporter moiety. In some embodiments, the core is labeled with a detectable reporter moiety. In some embodiments, at least one linker and/or at least one nucleotide unit of a nucleotide arm is labeled with a detectable reporter moiety. In some embodiments, the detectable reporter moiety comprises a fluorophore. An exemplary nucleotide arm is shown in FIG. 108, and exemplary multivalent molecules are shown in FIGS. 104-107.

In some embodiments, the sequencing polymerases of step (e) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (e) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

In some embodiments, the pairwise sequencing method further comprises step (f): retaining the plurality of immobilized concatemer template molecules and replacing the plurality of extended forward sequencing primer strands with a plurality of forward extension strands that are hybridized to the retained immobilized single stranded nucleic acid concatemer template molecules. The plurality of extended forward sequencing primer strands can be removed and replaced with a plurality of forward extension strands by conducting a primer extension reaction (see FIGS. 63-65).

In some embodiments, step (f) comprises contacting at least one extended forward sequencing primer strand with a plurality of strand displacing polymerases and a plurality of nucleotides and in the absence of soluble amplification primers, under a condition suitable to conduct a strand displacing primer extension reaction using the at least one extended forward sequencing primers strand to initiate the primer extension reaction thereby generating a forward extension strand that is covalently joined to the extended forward sequencing primers strand, wherein the forward extension strand is hybridized to the immobilized concatemer template molecule (FIG. 63). For example, one of the extended forward sequencing primer strands can serve as a primer for the strand displacing polymerase. The strand displacing polymerase can extend the extended forward sequencing primer strand, and displace downstream extended forward sequencing primer strands while synthesizing an extended strand that replaces the downstream extended forward sequencing primer strands. The newly extended strand is covalently joined to an extended forward sequencing primer strand. The immobilized concatemer template molecules are retained. The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine III). Inclusion of compaction oligonucleotides and/or hexamine (e.g., cobalt hexamine III) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 μm or smaller.

Examples of strand displacing polymerases include phi29 DNA polymerase, large fragment of Bst DNA polymerase, large fragment of Bsu DNA polymerase (exo-), Bca DNA polymerase (exo-), Klenow fragment of *E. coli* DNA polymerase, T5 polymerase, M-MuLV reverse transcriptase, HIV viral reverse transcriptase, Deep Vent® DNA polymerase and KOD DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio).

In some embodiments, step (f) comprises: (i) removing the plurality of extended forward sequencing primer strand while retaining the immobilized concatemer template molecules; and (ii) contacting the plurality of retained immobilized concatemer molecules with a plurality of soluble forward sequencing primers (e.g., a second plurality of soluble forward sequencing primers), a plurality of nucleotides (e.g., a second plurality of nucleotides) and a plurality of primer extension polymerases, under a condition suitable to hybridize the plurality of soluble forward sequencing primers to the plurality of retained immobilized concatemer template molecules and suitable for conducting polymerase-catalyzed primer extension reactions thereby generating a plurality of forward extension strands, wherein the soluble sequencing primers hybridize with the forward sequencing primer binding sequence in the retained immobilized concatemer molecules (FIG. 64). The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine III). Inclusion of compaction oligonucleotides and/or hexamine (e.g., cobalt hexamine Ill) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 μm or smaller.

In some embodiments, in step (f), the condition suitable to hybridize the plurality of soluble forward sequencing primers to the plurality of retained immobilized single stranded nucleic acid concatemer template molecules comprises hybridizing retained immobilized concatemer template molecules with the soluble primers in the presence of a primer extension polymerase, a plurality of nucleotides, and a high efficiency hybridization buffer. In some embodiment, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10/a by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, step (f) comprises: (i) removing the plurality of extended forward sequencing primer strand while retaining the immobilized concatemer template molecules; and (ii) contacting the plurality of retained immobilized concatemer molecules with a plurality of soluble amplification primers, a plurality of nucleotides (e.g., a second plurality of nucleotides) and a plurality of primer extension polymerases, under a condition suitable to hybridize the plurality of soluble amplification primers to the plurality of retained immobilized concatemer template molecules and suitable for conducting polymerase-catalyzed primer extension reactions thereby generating a plurality of forward extension strands, wherein the soluble amplification primers hybridize with the soluble amplification primer binding sequence in the retained immobilized concatemer molecules (FIG. 65). The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine III). Inclusion of compaction oligonucleotides and/or hexamine (e.g., cobalt hexamine III) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 μm or smaller.

In some embodiments, in step (f), the condition suitable to hybridize the plurality of soluble amplification primers to the plurality of retained immobilized single stranded nucleic acid concatemer template molecules comprises hybridizing retained immobilized concatemer template molecules with the soluble primers in the presence of a primer extension polymerase, a plurality of nucleotides, and a high efficiency hybridization buffer. In some embodiment, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, in step (f), the plurality of extended forward sequencing primer strands can be removed using an enzyme or a chemical reagent. For example, the plurality of extended forward sequencing primer strands can be enzymatically degraded using a 5' to 3' double-stranded DNA exonuclease, including T7 exonuclease (e.g., from New England Biolabs, catalog #M0263S). In some embodiments, the plurality of extended forward sequencing primer strands can be removed with a temperature that favors nucleic acid denaturation.

In some embodiments, in step (f), a denaturation reagent can be used to remove the plurality of extended forward sequencing primer strands, wherein the denaturation reagent comprises any one or any combination of compounds such as formamide, acetonitrile, guanidinium chloride and/or a buffering agent (e.g., Tris-HCl, MES, HEPES, or the like).

In some embodiments, in step (f), the plurality of extended forward sequencing primer strands can be removed using an elevated temperature (e.g., heat) with or without a nucleic acid denaturation reagent. The plurality of extended forward sequencing primer strands can be subjected to a temperature of about 45-50° C., or about 50-60° C., or about 60-70° C., or about 70-80° C., or about 80-90° C., or about 90-95° C., or higher temperature.

In some embodiments, in step (f), the plurality of extended forward sequencing primer strands can be removed using 100% formamide at a temperature of about 65° C. for about 3 minutes, and washing with a reagent comprising about 50 mM NaCl or equivalent ionic strength and having a pH of about 6.5-8.5.

In some embodiments, the primer extension polymerase of step (f) comprises a high fidelity polymerase. In some embodiments, the primer extension polymerase of step (d) comprises a DNA polymerase capable of catalyzing a primer extension reaction using a uracil-containing template molecule (e.g., a uracil-tolerant polymerase). Exemplary polymerases include, but are not limited to, Q5U® Hot Start high-fidelity DNA polymerase (e.g., catalog #M0515S from New England Biolabs), Taq DNA polymerase, OneTaq® DNA polymerase (e.g., mixture of Taq and Deep Vent® DNA polymerases, catalog #M0480S from New England Biolabs), LongAmp® Taq DNA polymerase (e.g., catalog #M0323S from New England Biolabs), EpiMark® Hot Start Taq DNA polymerase (e.g., catalog #M0490S from New England Biolabs), Bst DNA polymerase (e.g., large fragment, catalog #M0275S from New England Biolabs), Bsu DNA polymerase (e.g., large fragment, catalog #M0330S from New England Biolabs), Phi29 DNA polymerase (e.g., catalog #M0269S from New England Biolabs), E. coli DNA polymerase (e.g., catalog #M0209S from New England Biolabs), Terminator™ DNA polymerase (e.g., catalog #M0261S from New England Biolabs), Vent® DNA polymerase and Deep Vent® DNA polymerase.

The pairwise methods described herein can provide increased accuracy in a downstream sequencing reaction because step (f) replaces the extended forward sequencing primer strands that were generated in step (e) with forward extension strands having reduced base errors. The extended forward sequencing primer strands are generated in step (e) and may or may not contain erroneously incorporated nucleotides due to polymerase-catalyzed mis-paired bases. When step (e) is conducted with a high fidelity DNA polymerase, the resulting forward extension strands may have reduced base errors compared to the extended forward sequencing primer strands. The forward extension strands will be used as a nucleic acid template for a downstream sequencing step (e.g., see step (h) below). Thus, step (f) can increase the sequencing accuracy of the downstream step (h) and therefore increase the overall sequencing accuracy of the pairwise sequencing workflow.

In some embodiments, the pairwise sequencing method further comprises step (g): removing the retained immobilized concatemer template molecules by generating abasic sites in the immobilized single stranded concatemer template molecules at the nucleotide(s) having the scissile moiety and generating gaps at the abasic sites to generate a plurality of gap-containing single stranded nucleic acid concatemer template molecules while retaining the plurality of forward extension strands and retaining the plurality of immobilized surface primers (FIGS. 66 and 67, and FIGS. 68 and 69).

The abasic sites are generated on the retained concatemer template strands that contain nucleotides having scissile moieties. In some embodiments, the scissile moieties in the retained concatemer template molecules comprises uridine, 8-oxo-7,8-dihydroguanine (e.g., 8oxoG) or deoxyinosine. The abasic sites can be removed to generate a plurality of single stranded nucleic acid template molecules having gaps while retaining the plurality of forward extension strands. The abasic sites can be generated by contacting the immobilized concatemer template molecules with an enzyme that removes the nucleo-base at the nucleotide having the scissile moiety. The uracil in the retained concatemer template strands can be converted to an abasic site using uracil DNA glycosylase (UDG). The 8oxoG in the retained concatemer template strands can be converted to an abasic site using FPG glycosylase. The deoxyinosine in the retained concatemer template strands can be converted to an abasic site using AlkA glycosylase.

In some embodiments, in step (g), the gaps can be generated by contacting the abasic sites in the immobilized concatemer template molecules with an enzyme or a mixture of enzymes having lyase activity that breaks the phosphodiester backbone at the 5' and 3' sides of the abasic site to release the base-free deoxyribose and generate a gap (FIGS. 66 and 68). The abasic sites can be removed using AP lyase, Endo IV endonuclease, FPG glycosylase/AP lyase, Endo VIII glycosylase/AP lyase. In some embodiments, generating the abasic sites and removal of the abasic sites to generate gaps can be achieved using a mixture of uracil DNA glycosylase and DNA glycosylase-lyase endonuclease VIII, for example USER™ (Uracil-Specific Excision Reagent Enzyme from New England Biolabs) or thermolabile USER (also from New England Biolabs).

In some embodiments, in step (g), the plurality of gap-containing template molecules can be removed using an enzyme, chemical compound and/or heat. After the gap-removal procedure, the plurality of retained forward extension strands are hybridized to the retained immobilized surface primers (FIGS. 67 and 69).

For example, the plurality of gap-containing template molecules can be enzymatically degraded using a 5' to 3' double-stranded DNA exonuclease, including T7 exonuclease (e.g., from New England Biolabs, catalog #M0263S). When a 5' to 3' double-stranded DNA exonuclease is used for removing gap-containing template molecules, then the plurality of soluble amplification primers in step (f) can comprise at least one phosphorothioate diester bond at their 5' ends which can render the soluble amplification primers resistant to exonuclease degradation. In some embodiments, the plurality of soluble amplification primers in step (f) comprise 2-5 or more consecutive phosphorothioate diester bonds at their 5' ends. In some embodiments, the plurality soluble amplification primers in step (f) comprise at least one ribonucleotide and/or at least one 2'-O-methyl or 2'-O-methoxyethyl (MOE) nucleotide which can render the forward sequencing primers resistant to exonuclease degradation.

In some embodiments, the plurality of gap-containing template molecules can be removed using a chemical reagent that favors nucleic acid denaturation. The denaturation reagent can include any one or any combination of compounds such as formamide, acetonitrile, guanidinium chloride and/or a buffering agent (e.g., Tris-HCl, MES, HEPES, or the like).

In some embodiments, the plurality of gap-containing template molecules can be removed using an elevated temperature (e.g., heat) with or without a nucleic acid denaturation reagent. The gap-containing template molecules can be subjected to a temperature of about 45-50° C., or about 50-60° C., or about 60-70° C., or about 70-80° C., or about 80-90° C., or about 90-95° C., or higher temperature.

In some embodiments, the plurality of gap-containing template molecules can be removed using 100% formamide at a temperature of about 65° C. for about 3 minutes, and washing with a reagent comprising about 50 mM NaCl or equivalent ionic strength and having a pH of about 6.5-8.5.

In some embodiments, the pairwise sequencing method further comprises step (h): sequencing the plurality of retained forward extension strands thereby generating a plurality of extended reverse sequencing primer strands. In some embodiments, the sequencing of step (h) comprises contacting the plurality of retained forward extension strands with a plurality of soluble reverse sequencing primers under a condition suitable to hybridize the reverse sequencing primers to the reverse sequencing primer binding site of the retained forward extension strands, and by conducting sequencing reactions using the hybridized reverse sequencing primers wherein the forward sequencing reactions generates a plurality of extended reverse sequencing primer strands (FIGS. 70 and 71). The extended reverse sequencing primer strands are hybridized to the retained forward extension strand. The retained forward extension strand is hybridized to the first surface primer. The extended reverse sequencing primer strands are not hybridized to the first surface primer, or covalently joined to the first surface primer. Therefore, the extended reverse sequencing primer strands are not immobilized to the support.

In some embodiments, in step (h), the condition suitable to hybridize the reverse sequencing primers to the reverse sequencing primer binding sequences of the retained forward sequencing primer binding sequences of the retained forward extension strands comprises contacting the plurality of soluble reverse sequencing primers and the retained forward extension strands with a high efficiency hybridization buffer. In some embodiments, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In an alternative embodiment, the sequencing of step (h) comprises using the immobilized surface primer as a sequencing primer and conducting sequencing reactions to generate a plurality of reverse sequencing strands.

In some embodiments, the reverse sequencing reactions of step (h) comprises contacting the plurality of reverse sequencing primers with the reverse sequencing primer binding sequences of the retained forward extension strands, one or more types of sequencing polymerases, and a plurality of nucleotides and/or a plurality of multivalent molecules. In some embodiments, the soluble reverse sequencing primers comprise 3' OH extendible ends. In some embodiments, the soluble reverse sequencing primers comprise a 3' blocking moiety which can be removed to generate a 3' OH extendible end. In some embodiments, the soluble reverse sequencing primers lack a nucleotide having a scissile moiety. The sequencing reactions that employ nucleotides and/or multivalent molecules is described in more detail below. The reverse sequencing reactions can generate a plurality of extended reverse sequencing primer strands. In some embodiments, individual retained forward extension strands have multiple copies of the reverse sequencing primer binding sequences/sites, wherein each reverse sequencing primer binding site is capable of hybridizing to a reverse sequencing primer. Individual reverse sequencing primer binding sites in a given retained forward extension strand can be hybridized to a reverse sequencing primer and can undergo a sequencing reaction. Thus, an individual retained forward extension strand can undergo two or more sequence reactions, where each sequencing reaction is initiated from a reverse sequencing primer that is hybridized to a reverse sequencing primer binding site (e.g., see FIGS. 70 and 71). In some embodiments, the sequencing reactions comprise a plurality of nucleotides (or analogs thereof) labeled with a detectable reporter moiety. In some embodiments, the sequencing reaction comprise a plurality of multivalent molecules having nucleotide units, where the multivalent molecules are labeled with a detectable reporter moiety. In some embodiments, the detectable reporter moiety comprises a fluorophore.

In some embodiments, the sequencing polymerases of step (h) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (h) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

In some embodiments, at least one washing step can be conducted after any of steps (a)-(h). The washing step can be conducted with a wash buffer comprising a pH buffering agent, a metal chelating agent, a salt, and a detergent.

In some embodiments, the pH buffering compound in the wash buffer comprises any one or any combination of two or more of Tris, Tris-HCl, Tricine, Bicine, Bis-Tris propane, HEPES, MES, MOPS, MOPSO, BES, TES, CAPS, TAPS, TAPSO, ACES, PIPES, ethanolamine (a.k.a 2-amino methanol; MEA), a citrate compound, a citrate mixture, NaOH and/or KOH. In some embodiments, the pH buffering agent can be present in the wash buffer at a concentration of about 1-100 mM, or about 10-50 mM, or about 10-25 mM. In some embodiments, the pH of the pH buffering agent which is present in any of the reagents described here in can be adjusted to a pH of about 4-9, or a pH of about 5-9, or a pH of about 5-8.

In some embodiments, the metal chelating agent in the wash buffer comprises EDTA (ethylenediaminetetraacetic acid), EGTA (ethylene glycol tetraacetic acid), HEDTA (hydroxyethylethylenediaminetriacetic acid), DPTA (diethylene triamine pentaacetic acid), NTA (N,N-bis(carboxymethyl)glycine), citrate anhydrous, sodium citrate, calcium citrate, ammonium citrate, ammonium bicitrate, citric acid, potassium citrate, or magnesium citrate. In some embodiments, the wash buffer comprises a chelating agent at a concentration of about 0.01-50 mM, or about 0.1-20 mM, or about 0.2-10 mM.

In some embodiments, the salt in the wash buffer comprises NaCl, KCl, $NH_2SO_4$ or potassium glutamate. In some embodiments, the detergent comprises an ionic detergent such as SDS (sodium dodecyl sulfate). The wash buffer can include a monovalent salt at a concentration of about 25-500 mM, or about 50-250 mM, or about 100-200 mM.

In some embodiments, the detergent in the wash buffer comprises a non-ionic detergent such as Triton X-100, Tween 20, Tween 80 or Nonidet P40. In some embodiments, the detergent comprises a zwitterionic detergent such as CHAPS (3-[(3-cholamidopropyl)dimethylammonio]-1-propanesulfonate) or N-Dodecyl-N,N-dimethyl-3-amonio-1-propanesulfate (DetX). In some embodiments, the detergent comprises LDS (lithium dodecyl sulfate), sodium taurodeoxycholate, sodium taurocholate, sodium glycocholate, sodium deoxycholate or sodium cholate. In some embodiments, the detergent is included in the wash buffer at a concentration of about 0.01-0.05%, or about 0.05-0.1%, or about 0.1-0.15%, or about 0.15-0.2%, or about 0.2-0.25%.

Methods for Pairwise Sequencing—Lacking Abasic Sites

The present disclosure provides pairwise sequencing methods, comprising step (a): providing a plurality of immobilized single stranded nucleic acid concatemer template molecules each lacking a scissile moiety that can be cleaved to generate an abasic site in the concatemer template molecule, wherein individual concatemer template molecules in the plurality are immobilized to a first surface primer that is immobilized to a support, and wherein the immobilized first surface primer lacks a nucleotide having a scissile moiety. In some embodiments, the support comprises a plurality of first surface primers. In some embodiments, the support lacks a plurality of second surface primers. In some embodiments, the support comprises a plurality of first and second surface primers. Exemplary nucleotides having a scissile moiety include uridine, 8-oxo-7,8-dihydroguanine (e.g., 8oxoG) and deoxyinosine.

In some embodiments, individual immobilized concatemer template molecules are covalently joined to an immobilized surface primer (e.g., an immobilized first surface primer) (FIG. 73). In an alternative embodiment, individual immobilized concatemer template molecules are hybridized to an immobilized surface primer (e.g., an immobilized first surface primer) (FIG. 80).

In some embodiments, individual concatemer template molecules in the plurality comprise two or more copies of a sequence of interest, and wherein the individual immobilized concatemer template molecules further comprise any one or any combination of two or more of: (i) two or more copies of a universal binding sequence for a soluble forward sequencing primer, (ii) two or more copies of a universal binding sequence for a soluble reverse sequencing primer, (iii) two or more copies of a universal binding sequence for an immobilized first surface primer, (iv) two or more copies of a universal binding sequence for an immobilized second surface primer, (v) two or more copies of a universal binding sequence for a first soluble amplification primer, (vi) two or more copies of a universal binding sequence for a second soluble amplification primer, (vii) two or more copies of a universal binding sequence for a soluble compaction oligonucleotide, (viii) two or more copies of a sample barcode sequence and/or (ix) two or more copies of a unique molecular index sequence.

In some embodiments, individual concatemer template molecules in the plurality comprise two or more copies of a sequence of interest and two or more copies of a universal binding sequence for a soluble compaction oligonucleotide, and wherein the individual immobilized concatemer template molecules further comprise any one or any combination of two or more of: (i) two or more copies of a universal binding sequence for a soluble forward sequencing primer, (ii) two or more copies of a universal binding sequence for a soluble reverse sequencing primer, (iii) two or more copies of a universal binding sequence for an immobilized first surface primer, (iv) two or more copies of a universal binding sequence for an immobilized second surface primer, (v) two or more copies of a universal binding sequence for a first soluble amplification primer, (vi) two or more copies of a universal binding sequence for a second soluble amplification primer, (vii) two or more copies of a sample barcode sequence and/or (viii) two or more copies of a unique molecular index sequence.

In some embodiments, the universal binding sequence (or a complementary sequence thereof) for the forward sequencing primer can hybridize to at least a portion of the forward sequencing primer. In some embodiments, the universal binding sequence (or a complementary sequence thereof) for the reverse sequencing primer can hybridize to at least a portion of the reverse sequencing primer. In some embodiments, the universal binding sequence (or a complementary sequence thereof) for the immobilized first surface primer can hybridize to at least a portion of the immobilized first surface primer. In some embodiments, the universal binding sequence (or a complementary sequence thereof) for the immobilized second surface primer can hybridize to at least a portion of the immobilized second surface primer. In some embodiments, the universal binding sequence (or a complementary sequence thereof) for the first soluble amplification primer can hybridize to at least a portion of the first soluble amplification primer. In some embodiments, the universal binding sequence (or a complementary sequence thereof) for the second soluble amplification primer can hybridize to at least a portion of the second soluble amplification primer. In some embodiments, the universal binding sequence (or a complementary sequence thereof) for the soluble compaction oligonucleotide can hybridize to at least a portion of the soluble compaction oligonucleotide.

In some embodiments, the immobilized first surface primers comprise single stranded oligonucleotides comprising DNA, RNA or a combination of DNA and RNA. The immobilized first surface primers can be immobilized to the support or immobilized to a coating on the support. The immobilized first surface primers can be embedded and attached (coupled) to the coating on the support. In some embodiments, the 5' end of the immobilized first surface primers are immobilized to a support or immobilized to a coating on the support. Alternatively, an interior portion or the 3' end of the immobilized first surface primers can be immobilized to a support or immobilized to a coating on the support. The support comprises a plurality of immobilized first surface primers having the same sequence. The immobilized first surface primers can be any length, for example 4-50 nucleotides, or 50-100 nucleotides, or 100-150 nucleotides, or longer lengths. In some embodiments, the 3' terminal end of the immobilized first surface primers comprise an extendible 3' OH moiety. In some embodiments, the 3' terminal end of the immobilized first surface primers comprise a 3' non-extendible moiety.

In some embodiments, the plurality of immobilized first surface primers comprise at least one phosphorothioate diester bond at their 5' ends which can render the first surface primers resistant to exonuclease degradation. In some embodiments, the plurality of immobilized first surface primers comprise 2-5 or more consecutive phosphorothioate diester bonds at their 5' ends. In some embodiments, the plurality of immobilized first surface primers comprise at least one ribonucleotide and/or at least one 2'-O-methyl or 2'-O-methoxyethyl (MOE) nucleotide which can render the first surface primers resistant to exonuclease degradation.

In some embodiments, the immobilized first surface primers comprise at least one locked nucleic acid (LNA) which comprises a methylene bridge bond between a 2' oxygen and 4' carbon of the pentose ring. Immobilized first surface primers that include at least one LNA can be resistant to nuclease digestions and can exhibit increased melting temperature when hybridized to the forward extension strand.

In some embodiments, the immobilized concatemer template molecules further comprise two or more copies of a universal binding sequence (or complementary sequence thereof) for an immobilized second surface primer having a sequence that differs from the first immobilized surface primer. The immobilized second surface primers of step (a) comprise single stranded oligonucleotides comprising DNA, RNA or a combination of DNA and RNA. The immobilized second surface primers can be immobilized to the support or immobilized to a coating on the support. The immobilized second surface primers can be embedded and attached (coupled) to the coating on the support. In some embodiments, the 5' end of the immobilized second surface primers are immobilized to a support or immobilized to a coating on the support. Alternatively, an interior portion or the 3' end of the immobilized second surface primers can be immobilized to a support or immobilized to a coating on the support. The support comprises a plurality of immobilized second surface primers having the same sequence. The immobilized second surface primers can be any length, for example 4-50 nucleotides, or 50-100 nucleotides, or 100-150 nucleotides, or longer lengths.

In some embodiments, the 3' terminal end of the immobilized second surface primers comprise an extendible 3' OH moiety. In some embodiments, the 3' terminal end of the immobilized second surface primers comprise a 3' non-extendible moiety. In some embodiments, the 3' terminal end of the immobilized second surface primers comprise a moiety that blocks primer extension (e.g., non-extendible terminal 3' end), such as for example a phosphate group, a dideoxycytidine group, an inverted dT, or an amino group. The immobilized second surface primers are not extendible in a primer extension reaction. The immobilized second surface primers lack a nucleotide having a scissile moiety.

In some embodiments, the plurality of immobilized second surface primers comprise at least one phosphorothioate diester bond at their 5' ends which can render the second surface primers resistant to exonuclease degradation. In some embodiments, the plurality of immobilized second surface primers comprise 2-5 or more consecutive phosphorothioate diester bonds at their 5' ends. In some embodiments, the plurality of immobilized second surface primers comprise at least one ribonucleotide and/or at least one 2'-O-methyl or 2'-O-methoxyethyl (MOE) nucleotide which can render the second surface primers resistant to exonuclease degradation.

In some embodiments, individual immobilized single stranded nucleic acid concatemer template molecules are joined or immobilized to an immobilized first surface primer, and at least one portion of the individual concatemer template molecule is hybridized to an immobilized second surface primer. The immobilized second surface primers serve to pin down a portion of the immobilized concatemer template molecules to the support (see FIGS. 79 and 86).

In some embodiments, the support comprises about $10^2$-$10^{15}$ immobilized first surface primers per mm$^2$. In some embodiments, the support comprises about $10^2$-$10^{15}$ immobilized second surface primers per mm$^2$. In some embodiments, the support comprises about $10^2$-$10^{15}$ immobilized first surface primers and immobilized second surface primers per mm$^2$.

The immobilized surface primers (e.g., first and second surface primers) are in fluid communication with each other to permit flowing various solutions of linear or circular nucleic acid template molecules, soluble primers, enzymes, nucleotides, divalent cations, buffers, reagents, and the like, onto the support so that the plurality of immobilized surface primers (and the primer extension products generated from the immobilized surface primers) react with the solutions in a massively parallel manner.

In some embodiments, the pairwise sequencing method further comprises step (b): sequencing the plurality of immobilized concatemer template molecules thereby generating a plurality of extended forward sequencing primer strands. The sequencing of step (b) comprises contacting the plurality of immobilized concatemer template molecules with a plurality of soluble forward sequencing primers under a condition suitable to hybridize at least one forward sequencing primer to at least one of the forward sequencing primer binding sites/sequences of the immobilized concatemer template molecules, and conducting forward sequencing reactions using one or more types of sequencing polymerases, a plurality of nucleotides and/or multivalent molecules, and the hybridized first forward sequencing primers. In some embodiments, the soluble forward sequencing primers comprise 3' OH extendible ends. In some embodiments, the soluble forward sequencing primers comprise a 3' blocking moiety which can be removed to generate a 3' OH extendible end. In some embodiments, the soluble forward sequencing primers lack a nucleotide having a scissile moiety. The forward sequencing reactions can generate a plurality of extended forward sequencing primer strands. In some embodiments, individual immobilized concatemer template molecules have multiple copies of the forward sequencing primer binding sites, wherein each forward sequencing primer binding site is capable of hybridizing to a first forward sequencing primer. Individual forward sequencing primer binding sites in a given immobilized concatemer template molecule can be hybridized to a forward sequencing primer and can undergo a sequencing reaction. Individual immobilized concatemer template molecules can undergo two or more sequence reactions, where each sequencing reaction is initiated from a first forward sequencing primer that is hybridized to a forward sequencing primer binding site (e.g., see FIGS. 74 and 81). In some embodiments, the sequencing reactions comprise a plurality of nucleotides (or analogs thereof) labeled with a detectable reporter moiety. In some embodiments, the sequencing reaction comprise a plurality of multivalent molecules having a plurality of nucleotide units attached to a core, where the multivalent molecules are labeled with a detectable reporter moiety. In some embodiments, the core is labeled with a detectable reporter moiety. In some embodiments, at least one linker and/or at least one nucleotide unit of a nucleotide arm is labeled with a detectable reporter moiety. In some embodiments, the detectable reporter moiety comprises a fluorophore. An exemplary nucleotide arm is shown in FIG. 108, and exemplary multivalent molecules are shown in FIGS. 104-107.

In some embodiments, the sequencing polymerases of step (b) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (b) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

In some embodiments, the pairwise sequencing method further comprises step (c): retaining the plurality of immobilized concatemer template molecules and replacing the plurality of extended forward sequencing primer strands with a plurality of forward extension strands by conducting a primer extension reaction. The extended forward sequencing primer strands can be removed from the retained immobilized concatemer template molecules. The retained immobilized concatemer template molecule can be hybridized to a plurality of soluble amplification or sequencing primers and subjected to a primer extension reaction. The primer extension reaction can be conducted with a plurality of soluble primers (e.g., soluble amplification primers or soluble forward sequencing primers) and a plurality of strand-displacing polymerases to generate a plurality of forward extension strands that are hybridized to the immobilized concatemer template molecules, and a plurality of partially displaced forward extension strands that are hybridized to the immobilized concatemer template molecules to form a plurality of immobilized amplicons. The strand displacing primer extension reaction also generate a plurality of detached forward extension strands that are not hybridized to the immobilized concatemer template molecules. In some embodiments, the strand displacing primer extension reaction can be conducted in the presence of a plurality of soluble compaction oligonucleotides to immobilize the detached forward extension strands to the immobilized amplicons (see FIGS. 75-77 and FIGS. 82-84).

Examples of strand displacing polymerases include phi29 DNA polymerase, large fragment of Bst DNA polymerase, large fragment of Bsu DNA polymerase (exo-), Bca DNA polymerase (exo-), Klenow fragment of E. coli DNA polymerase, T5 polymerase, M-MuLV reverse transcriptase, HIV viral reverse transcriptase, Deep Vent® DNA polymerase and KOD DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio).

In some embodiments, step (c) comprises: (i) removing the plurality of extended forward sequencing primer strand while retaining the immobilized concatemer template molecules; and (ii) contacting the plurality of retained immobilized concatemer molecules with a plurality of soluble amplification primers, a plurality of nucleotides (e.g., a second plurality of nucleotides) and a plurality of strand displacing polymerases, under a condition suitable to hybridize the plurality of soluble amplification primers to the plurality of retained immobilized concatemer template molecules and suitable for conducting a strand displacing primer extension reactions thereby generating a plurality of forward extension strands and a plurality of partially displaced forward extension strands that are hybridized to the immobilized concatemer template molecules, and a plurality of detached forward extension strands that are not hybridized to the immobilized concatemer template molecules. The soluble amplification primers hybridize with the soluble amplification primer binding sequence in the retained immobilized concatemer molecules (FIGS. 75 and 82). The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine III). Inclusion of compaction oligonucleotides and/or hexamine (e.g., cobalt hexamine III) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 µm or smaller.

In some embodiments, step (c) comprises: (i) removing the plurality of extended forward sequencing primer strand while retaining the immobilized concatemer template molecules; and (ii) contacting the plurality of retained immobilized concatemer molecules with a plurality of soluble sequencing primers, a plurality of nucleotides (e.g., a second plurality of nucleotides) and a plurality of strand displacing polymerases, under a condition suitable to hybridize the plurality of soluble sequencing primers to the plurality of retained immobilized concatemer template molecules and suitable for conducting a strand displacing primer extension reactions thereby generating a plurality of forward extension strands and a plurality of partially displaced forward extension strands that are hybridized to the immobilized concatemer template molecules, and a plurality of detached forward extension strands that are not hybridized to the immobilized concatemer template molecules. The soluble forward sequencing primers hybridize with the forward sequencing primer binding sequence in the retained immobilized concatemer molecules. The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine Ill). Inclusion of compaction oligonucleotides and/or hexamine (e.g., cobalt hexamine III) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 µm or smaller.

In some embodiments, in step (c), the condition suitable to hybridize the plurality of soluble amplification primers to the plurality of retained immobilized single stranded nucleic acid concatemer template molecules comprises hybridizing the retained immobilized concatemer template molecules with the soluble amplification primers in the presence of a primer extension polymerase, a plurality of nucleotides, and a high efficiency hybridization buffer. In some embodiment, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, in step (c), the plurality of extended forward sequencing primer strands can be removed using an enzyme or a chemical reagent. For example, the plurality of extended forward sequencing primer strands can be enzymatically degraded using a 5' to 3' double-stranded DNA exonuclease, including T7 exonuclease (e.g., from New England Biolabs, catalog #M0263S). In some embodiments, the plurality of extended forward sequencing primer strands can be removed with a temperature that favors nucleic acid denaturation.

In some embodiments, in step (c), a denaturation reagent can be used to remove the plurality of extended forward sequencing primer strands, wherein the denaturation reagent comprises any one or any combination of compounds such as formamide, acetonitrile, guanidinium chloride and/or a pH buffering agent (e.g., Tris-HCl, MES, HEPES, MOPS, or the like). Optionally, the denaturation reagent can further comprise PEG.

In some embodiments, in step (c), the plurality of extended forward sequencing primer strands can be removed using an elevated temperature (e.g., heat) with or without a nucleic acid denaturation reagent. The plurality of extended forward sequencing primer strands can be subjected to a temperature of about 45-50° C., or about 50-60° C., or about 60-70° C., or about 70-80° C., or about 80-90° C., or about 90-95° C., or higher temperature.

In some embodiments, in step (c), the plurality of extended forward sequencing primer strands can be removed using 100% formamide at a temperature of about 65° C. for about 3 minutes, and washing with a reagent comprising about 50 mM NaCl or equivalent ionic strength and having a pH of about 6.5-8.5.

In some embodiments, the pairwise sequencing method further comprises step (d): sequencing the plurality of immobilized partially displaced forward extension strands thereby generating a first plurality of extended reverse sequencing primer strands. In some embodiments, step (d) further comprises sequencing the plurality of immobilized detached forward extension strands thereby generating a second plurality of extended reverse sequencing primer strands. In some embodiments, individual immobilized partially displaced forward extension strands have two or more extended reverse sequencing primer strands hybridized thereon. In some embodiments, individual immobilized detached forward extension strands have two or more extended reverse sequencing primer strands hybridized thereon. During the sequencing of step (d), the immobilized partially displaced forward extension strands remain hybridized to the retained immobilized concatemer template molecules.

In some embodiments, the sequencing of step (d) comprises contacting the plurality of immobilized partially displaced forward extension strands (e.g., that are hybridized to the immobilized concatemer template molecules), and the plurality of immobilized detached forward extension strands, with a plurality of soluble reverse sequencing primers under a condition suitable to hybridize the reverse sequencing primers to the reverse sequencing primer binding site of the forward extension strands (FIGS. 78 and 85). The sequencing of step (d) comprises conducting sequencing reactions using the hybridized reverse sequencing primers wherein the forward sequencing reactions generates a plurality of extended reverse sequencing primer strands (FIGS. 78 and 85). The extended reverse sequencing primer strands are hybridized to a partially displaced forward extension strand that is hybridized to the immobilized concatemer template molecules, or an immobilized detached forward extension strand.

For the sake of simplicity, FIGS. 73-78 and 80-85 do not show an immobilized concatemer template molecule having a universal binding sequence for a soluble compaction oligonucleotide. The skilled artisan will appreciate that the immobilized concatemer template molecule can include a universal binding sequence for a soluble compaction oligonucleotide.

For the sake of simplicity, FIGS. 78 and 85 show an exemplary immobilized partially displaced forward extension strand that is hybridized to the immobilized concatemer template molecule, and the immobilized detached forward extension strand, each having one copy of an extended reverse sequencing primer strand hybridized thereon. The skilled artisan will appreciate that the immobilized partially displaced forward extension strand that is hybridized to the immobilized concatemer template molecule, and the immobilized detached forward extension strand, can have two or more copies of the extended reverse sequencing primer strands hybridized thereon. Therefore, the reverse sequencing reaction can generate a plurality of extended reverse sequencing primer strands hybridized to the same immobilized partially displaced forward extension strand that is hybridized to the immobilized concatemer template molecule, or the immobilized detached forward extension strand.

In some embodiments, the reverse sequencing reaction can include a plurality of compaction oligonucleotides. The compaction oligonucleotides can serve to immobilize one or more of the detached forward extension strands via hybridization to the immobilized partially displaced forward extension strand (e.g., that is hybridized to the immobilized concatemer template molecule).

In some embodiments, in step (d), the condition that is suitable to hybridize the reverse sequencing primers to the reverse sequencing primer binding sequences of the immobilized partially displaced forward extension strand that is hybridized to the immobilized concatemer template molecule, and the immobilized detached forward extension strand, comprises contacting the plurality of soluble reverse sequencing primers and the forward extension strands with a high efficiency hybridization buffer. In some embodiments, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, the reverse sequencing reactions of step (d) comprises contacting the plurality of soluble reverse sequencing primers with the reverse sequencing primer binding sequences of the immobilized partially displaced forward extension strand that is hybridized to the immobilized concatemer template molecule, or the immobilized detached forward extension strand, with one or more types of sequencing polymerases, and a plurality of nucleotides and/or a plurality of multivalent molecules. In some embodiments, the soluble reverse sequencing primers comprise 3' OH extendible ends. In some embodiments, the soluble reverse sequencing primers comprise a 3' blocking moiety which can be removed to generate a 3' OH extendible end. In some embodiments, the soluble reverse sequencing primers lack a nucleotide having a scissile moiety. The sequencing reactions that employ nucleotides and/or multivalent molecules is described in more detail below. The reverse sequencing reactions can generate a plurality of extended reverse sequencing primer strands. In some embodiments, individual forward extension strands have multiple copies of the reverse sequencing primer binding sequences/sites, wherein each reverse sequencing primer binding site is capable of hybridizing to a reverse sequencing primer. Individual reverse sequencing primer binding sites in a given immobilized partially displaced forward extension strand that is hybridized to the immobilized concatemer template molecule, or immobilized detached forward extension strand, can be hybridized to a reverse sequencing primer and can undergo a sequencing reaction. Thus, an individual retained forward extension strand can undergo two or more sequence reactions, where each sequencing reaction is initiated from a reverse sequencing primer that is hybridized to a reverse sequencing primer binding site. In some embodiments, the sequencing reactions comprise a plurality of nucleotides (or analogs thereof) labeled with a detectable reporter moiety.

In some embodiments, the sequencing reaction comprise a plurality of multivalent molecules having nucleotide units, where the multivalent molecules are labeled with a detectable reporter moiety. In some embodiments, the detectable reporter moiety comprises a fluorophore.

In some embodiments, the sequencing polymerases of step (d) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (d) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

In some embodiments, at least one washing step can be conducted after any of steps (a)-(d). The washing step can be conducted with a wash buffer comprising a pH buffering agent, a metal chelating agent, a salt, and a detergent.

In some embodiments, the pH buffering compound in the wash buffer comprises any one or any combination of two or more of Tris, Tris-HCl, Tricine, Bicine, Bis-Tris propane, HEPES, MES, MOPS, MOPSO, BES, TES, CAPS, TAPS, TAPSO, ACES, PIPES, ethanolamine (a.k.a 2-amino methanol; MEA), a citrate compound, a citrate mixture, NaOH and/or KOH. In some embodiments, the pH buffering agent can be present in the wash buffer at a concentration of about 1-100 mM, or about 10-50 mM, or about 10-25 mM. In some embodiments, the pH of the pH buffering agent which is present in any of the reagents described here in can be adjusted to a pH of about 4-9, or a pH of about 5-9, or a pH of about 5-8.

In some embodiments, the metal chelating agent in the wash buffer comprises EDTA (ethylenediaminetetraacetic acid), EGTA (ethylene glycol tetraacetic acid), HEDTA (hydroxyethylethylenediaminetriacetic acid), DPTA (diethylene triamine pentaacetic acid), NTA (N,N-bis(carboxymethyl)glycine), citrate anhydrous, sodium citrate, calcium citrate, ammonium citrate, ammonium bicitrate, citric acid, potassium citrate, or magnesium citrate. In some embodiments, the wash buffer comprises a chelating agent at a concentration of about 0.01-50 mM, or about 0.1-20 mM, or about 0.2-10 mM.

In some embodiments, the salt in the wash buffer comprises NaCl, KCl, $NH_2SO_4$ or potassium glutamate. In some embodiments, the detergent comprises an ionic detergent such as SDS (sodium dodecyl sulfate). The wash buffer can include a monovalent salt at a concentration of about 25-500 mM, or about 50-250 mM, or about 100-200 mM.

In some embodiments, the detergent in the wash buffer comprises a non-ionic detergent such as Triton X-100, Tween 20, Tween 80 or Nonidet P-40. In some embodiments, the detergent comprises a zwitterionic detergent such as CHAPS (3-[(3-cholamidopropyl)dimethylammonio]-1-propanesulfonate) or N-Dodecyl-N,N-dimethyl-3-amonio-1-propanesulfate (DetX). In some embodiments, the detergent comprises LDS (lithium dodecyl sulfate), sodium taurodeoxycholate, sodium taurocholate, sodium glycocholate, sodium deoxycholate or sodium cholate. In some embodiments, the detergent is included in the wash buffer at a concentration of about 0.01-0.05%, or about 0.05-0.1%, or about. 0.1-0.15%, or about 0.15-0.2%, or about 0.2-0.25%.

On Support RCA and Pairwise Sequencing—Lacking Abasic Sites

The present disclosure provides pairwise sequencing methods, comprising step (a): providing a support having a plurality of surface primers (e.g., a plurality of first surface primers) immobilized thereon wherein each of the surface primers have a 3' OH extendible end and lack a nucleotide having a scissile moiety (FIG. 87). For example, the surface primers lack uridine, 8-oxo-7,8-dihydroguanine (e.g., 8oxoG) and deoxyinosine. In some embodiments, the support comprises a plurality of first surface primers. In some embodiments, the support lacks a plurality of second surface primers. In some embodiments, the support comprises a plurality of first and second surface primers.

In some embodiments, the immobilized first surface primers comprise single stranded oligonucleotides comprising DNA, RNA or a combination of DNA and RNA. The first surface primers comprise a sequence that is wholly complementary or partially complementary along their lengths to at least a portion of a nucleic acid library molecule (e.g., linear or circular library molecules). The first surface primers can include a terminal 3' nucleotide having a sugar 3' OH moiety which is extendible for nucleotide polymerization (e.g., polymerase catalyzed polymerization).

The immobilized first surface primers can be immobilized to the support or immobilized to a coating on the support. The immobilized first surface primers can be embedded and attached (coupled) to the coating on the support. In some embodiments, the 5' end of the immobilized first surface primers are immobilized to a support or immobilized to a coating on the support. Alternatively, an interior portion or the 3' end of the immobilized first surface primers can be immobilized to a support or immobilized to a coating on the support. The support comprises a plurality of immobilized first surface primers having the same sequence. The immobilized first surface primers can be any length, for example 4-50 nucleotides, or 50-100 nucleotides, or 100-150 nucleotides, or longer lengths.

In some embodiments, the plurality of immobilized first surface primers comprise at least one phosphorothioate diester bond at their 5' ends which can render the first surface primers resistant to exonuclease degradation. In some embodiments, the plurality of immobilized first surface primers comprise 2-5 or more consecutive phosphorothioate diester bonds at their 5' ends. In some embodiments, the plurality of immobilized first surface primers comprise at least one ribonucleotide and/or at least one 2'-O-methyl or 2'-O-methoxyethyl (MOE) nucleotide which can render the first surface primers resistant to exonuclease degradation.

In some embodiments, the immobilized first surface primers comprise at least one locked nucleic acid (LNA) which comprises a methylene bridge bond between a 2' oxygen and 4' carbon of the pentose ring. Immobilized first surface primers that include at least one LNA can be resistant to nuclease digestions and can exhibit increased melting temperature when hybridized to the forward extension strand.

In some embodiments, the support further comprises a plurality of a second surface primer immobilized thereon (e.g., FIG. 79). The second surface primers have a sequence that differs from the first immobilized surface primer. The immobilized second surface primers of step (a) comprise single stranded oligonucleotides comprising DNA, RNA or a combination of DNA and RNA. The second surface primers comprise a sequence that is wholly complementary or partially complementary along their lengths to at least a portion of an immobilized single stranded concatemer template molecule. The immobilized second surface primers can be immobilized to the support or immobilized to a coating on the support. The immobilized second surface primers can be embedded and attached (coupled) to the coating on the support. In some embodiments, the 5' end of the immobilized second surface primers are immobilized to a support or immobilized to a coating on the support. Alternatively, an interior portion or the 3' end of the immobilized second surface primers can be immobilized to a support or immobilized to a coating on the support. The support comprises a plurality of immobilized second surface primers having the same sequence. The immobilized second surface primers can be any length, for example 4-50 nucleotides, or 50-100 nucleotides, or 100-150 nucleotides, or longer lengths. In some embodiments, the 3' terminal end of the immobilized second surface primers comprise an extendible 3' OH moiety. In some embodiments, the 3' terminal end of the immobilized second surface primers comprise a 3' non-extendible moiety. The 3' terminal end of the immobilized second surface primers comprise a moiety that blocks primer extension, such as for example a phosphate group, a dideoxycytidine group, an inverted dT, or an amino group. The immobilized second surface primers are not extendible in a primer extension reaction. The immobilized second surface primers lack a nucleotide having a scissile moiety.

In some embodiments, the plurality of immobilized second surface primers comprise at least one phosphorothioate diester bond at their 5' ends which can render the second surface primers resistant to exonuclease degradation. In some embodiments, the plurality of immobilized second surface primers comprise 2-5 or more consecutive phosphorothioate diester bonds at their 5' ends. In some embodiments, the plurality of immobilized second surface primers comprise at least one ribonucleotide and/or at least one 2'-O-methyl or 2'-O-methoxyethyl (MOE) nucleotide which can render the second surface primers resistant to exonuclease degradation.

In some embodiments, individual immobilized single stranded nucleic acid concatemer template molecule are covalently joined to an immobilized first surface primer, and at least one portion of the individual concatemer template molecule is hybridized to an immobilized second surface primer (e.g., FIG. 79). The immobilized second surface primers serve to pin down a portion of the immobilized concatemer template molecules to the support. The immobilized concatemer template molecule has two or more copies of a universal binding sequence for an immobilized second surface primer. The portion of the immobilized concatemer template molecule that includes the universal binding sequence for an immobilized second surface primer can hybridize to the immobilized second surface primer. In some embodiments, the second surface primers include a terminal 3' blocking group that renders them non-extendible. In some embodiments, the second surface primers have terminal 3' extendible ends.

In some embodiments, the support comprises about $10^2$-$10^{15}$ immobilized first surface primers per mm$^2$. In some embodiments, the support comprises about $10^2$-$10^{15}$ immobilized second surface primers per mm$^2$. In some embodiments, the support comprises about $10^2$-$10^{15}$ immobilized first surface primers and immobilized second surface primers per mm$^2$.

The immobilized surface primers (e.g., first and second surface primers) are in fluid communication with each other to permit flowing various solutions of linear or circular nucleic acid template molecules, soluble primers, enzymes, nucleotides, divalent cations, buffers, reagents, and the like, onto the support so that the plurality of immobilized surface primers (and the primer extension products generated from the immobilized surface primers) react with the solutions in a massively parallel manner.

The present disclosure provides pairwise sequencing methods, comprising step (b): generating a plurality of immobilized single stranded nucleic acid concatemer template molecules by hybridizing a plurality of single-stranded circular nucleic acid library molecules to the plurality of immobilized first surface primers and conducting a rolling circle amplification reaction. In some embodiments, the rolling circle amplification reaction can be conducted with a plurality of a strand displacing polymerase, and a plurality of nucleotides which lack a nucleotide having a scissile moiety that can be cleaved to generate an abasic site. In some embodiments, the plurality of nucleotides comprises any combination of dATP, dCTP, dGTP and/or dTTP. The rolling circle amplification reaction includes a mixture of nucleotides that lack a scissile moiety. Exemplary nucleotides having a scissile moiety include uridine, 8-oxo-7,8-dihydroguanine (e.g., 8oxoG) and deoxyinosine. In some embodiments, the rolling circle amplification reaction generates a plurality of immobilized single stranded nucleic acid concatemer template molecules that lack a nucleotide having a scissile moiety, wherein individual single stranded nucleic acid concatemer template molecules are covalently joined to an immobilized first surface primer (FIG. 88).

In some embodiments, the single-stranded circular nucleic acid library molecules comprise covalently closed circular molecules. In some embodiments, the single-stranded circular nucleic acid library molecules can be removed from the concatemer template molecules with at least one washing step which is conducted under a condition suitable to retain the single stranded nucleic acid concatemer template molecules where individual concatemer template molecules are operably joined to an immobilized first surface primer.

In some embodiments, individual single stranded circular nucleic acid library molecules in the plurality comprise a sequence of interest, and the individual immobilized concatemer template molecules further comprise any one or any combination of two or more of (i) a universal binding sequence (or complementary sequence thereof) for a soluble forward sequencing primer, (ii) a universal binding sequence (or complementary sequence thereof) for a soluble reverse sequencing primer, (iii) a universal binding sequence (or complementary sequence thereof) for an immobilized first surface primer, (iv) a universal binding sequence (or complementary sequence thereof) for an immobilized second surface primer, (v) a universal binding sequence (or complementary sequence thereof) for a first soluble amplification primer, (vi) a universal binding sequence (or complementary sequence thereof) for a second soluble amplification primer, (vii) a universal binding sequence (or complementary sequence thereof) for a soluble compaction oligonucleotide, (viii) a sample barcode sequence and/or (ix) a unique molecular index sequence.

In some embodiments, individual single stranded circular nucleic acid library molecules in the plurality comprise a sequence of interest and a universal binding sequence (or complementary sequence thereof) for a soluble compaction oligonucleotide, and the individual immobilized concatemer template molecules further comprise any one or any combination of two or more of (i) a universal binding sequence (or complementary sequence thereof) for a soluble forward sequencing primer, (ii) a universal binding sequence (or complementary sequence thereof) for a soluble reverse sequencing primer, (iii) a universal binding sequence (or complementary sequence thereof) for an immobilized first surface primer, (iv) a universal binding sequence (or complementary sequence thereof) for an immobilized second surface primer, (v) a universal binding sequence (or complementary sequence thereof) for a first soluble amplification primer, (vi) a universal binding sequence (or complementary sequence thereof) for a second soluble amplification primer, (vii) a sample barcode sequence and/or (viii) a unique molecular index sequence.

In some embodiments, the universal binding sequence (or a complementary sequence thereof) for the forward sequencing primer can hybridize to at least a portion of the forward sequencing primer. In some embodiments, the universal binding sequence (or a complementary sequence thereof) for the reverse sequencing primer can hybridize to at least a portion of the reverse sequencing primer. In some embodiments, the universal binding sequence (or a complementary sequence thereof) for the immobilized first surface primer can hybridize to at least a portion of the immobilized first surface primer. In some embodiments, the universal binding sequence (or a complementary sequence thereof) for the immobilized second surface primer can hybridize to at least a portion of the immobilized second surface primer. In some embodiments, the universal binding sequence (or a complementary sequence thereof) for the first soluble amplification primer can hybridize to at least a portion of the first soluble amplification primer. In some embodiments, the universal binding sequence (or a complementary sequence thereof) for the second soluble amplification primer can hybridize to at least a portion of the second soluble amplification primer. In some embodiments, the universal binding sequence (or a complementary sequence thereof) for the soluble compaction oligonucleotide can hybridize to at least a portion of the soluble compaction oligonucleotide.

In some embodiments, the rolling circle amplification reaction of step (b) generates a plurality of immobilized single stranded nucleic acid concatemer template molecules each comprising a concatemer lacking a nucleotide having a scissile moiety and two or more copies of a sequence of interest, and wherein the immobilized concatemer template molecules further comprise any one or any combination of two or more of: (i) two or more copies of a universal binding sequence (or a complementary sequence thereof) for a soluble forward sequencing primer, (ii) two or more copies of a universal binding sequence (or a complementary sequence thereof) for a soluble reverse sequencing primer, (iii) two or more copies of a universal binding sequence (or a complementary sequence thereof) for an immobilized first surface primer, (iv) two or more copies of a universal binding sequence (or a complementary sequence thereof) for an immobilized second surface primer, (v) two or more copies of a universal binding sequence (or a complementary sequence thereof) for a first soluble amplification primer, (vi) two or more copies of a universal binding sequence (or a complementary sequence thereof) for a second soluble amplification primer, (vii) two or more copies of a universal binding sequence (or a complementary sequence thereof) for a soluble compaction oligonucleotide, (viii) two or more copies of a sample barcode sequence and/or (ix) two or more copies of a unique molecular index sequence.

In some embodiments, the plurality of immobilized single stranded nucleic acid concatemer template molecules that are generated by the rolling circle amplification reaction of step (b) further comprise two or more copies of a universal binding sequence (or complementary sequence thereof) for immobilized second sequence surface primers. In some embodiments, individual immobilized single stranded nucleic acid concatemer template molecule are joined (e.g., covalently joined) to an immobilized first surface primer, and at least one portion of the individual concatemer template molecule is hybridized to an immobilized second surface primer. The immobilized second surface primers serve to pin down a portion of the immobilized concatemer template molecules to the support (e.g., see FIG. 79). In some embodiments, the second surface primers include a terminal 3' blocking group that renders them non-extendible.

The rolling circle amplification reaction of step (b) can be conducted with a nucleotide mixture containing dATP, dCTP, dGTP, dTTP, and the nucleotide mixture lacks a nucleotide having a scissile moiety. Exemplary nucleotides having a scissile moiety includes uridine, 8-oxo-7,8-dihydroguanine (e.g., 8oxoG) and deoxyinosine.

In some embodiments, the pairwise sequencing method further comprises step (c): sequencing the plurality of immobilized concatemer template molecules thereby generating a plurality of extended forward sequencing primer strands. The sequencing of step (c) comprises contacting the plurality of immobilized concatemer template molecules with a plurality of soluble forward sequencing primers under a condition suitable to hybridize at least one forward sequencing primer to at least one of the forward sequencing primer binding sites/sequences of the immobilized concatemer template molecules, and conducting forward sequencing reactions using one or more types of sequencing polymerases, a plurality of nucleotides and/or multivalent molecules, and the hybridized first forward sequencing primers. The forward sequencing reactions can generate a plurality of extended forward sequencing primer strands. In some embodiments, individual immobilized concatemer template molecules have multiple copies of the forward sequencing primer binding sites, wherein each forward sequencing primer binding site is capable of hybridizing to a first forward sequencing primer. Individual forward sequencing primer binding sites in a given immobilized concatemer template molecule can be hybridized to a forward sequencing primer and can undergo a sequencing reaction. Individual immobilized concatemer template molecules can undergo two or more sequence reactions, where each sequencing reaction is initiated from a first forward sequencing primer that is hybridized to a forward sequencing primer binding site (e.g., see FIG. 90). In some embodiments, the soluble forward sequencing primers comprise 3' OH extendible ends. In some embodiments, the soluble forward sequencing primers comprise a 3' blocking moiety which can be removed to generate a 3' OH extendible end. In some embodiments, the soluble forward sequencing primers lack a nucleotide having a scissile moiety. In some embodiments, the sequencing reactions comprise a plurality of nucleotides (or analogs thereof) labeled with a detectable reporter moiety. In some embodiments, the sequencing reaction comprise a plurality of multivalent molecules having a plurality of nucleotide units attached to a core, where the multivalent molecules are labeled with a detectable reporter moiety. In some embodiments, the core is labeled with a detectable reporter moiety. In some embodiments, at least one linker and/or at least one nucleotide unit of a nucleotide arm is labeled with a detectable reporter moiety. In some embodiments, the detectable reporter moiety comprises a fluorophore. An exemplary nucleotide arm is shown in FIG. 108, and exemplary multivalent molecules are shown in FIGS. 104-107.

In some embodiments, the sequencing polymerases of step (c) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (c) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

In some embodiments, the pairwise sequencing method further comprises step (d): retaining the plurality of immobilized concatemer template molecules and replacing the plurality of extended forward sequencing primer strands with a plurality of forward extension strands by conducting a primer extension reaction. The extended forward sequencing primer strands can be removed from the retained immobilized concatemer template molecules. The retained immobilized concatemer template molecule can be hybridized to a plurality of soluble amplification or sequencing primers and subjected to a primer extension reaction. The primer extension reaction can be conducted with a plurality of soluble primers (e.g., soluble amplification primers or soluble forward sequencing primers) and a plurality of strand-displacing polymerases to generate a plurality of forward extension strands that are hybridized to the immobilized concatemer template molecules, and a plurality of partially displaced forward extension strands that are hybridized to the immobilized concatemer template molecules to form a plurality of immobilized amplicons. The strand displacing primer extension reaction also generate a plurality of detached forward extension strands that are not hybridized to the immobilized concatemer template molecules. In some embodiments, the strand displacing primer extension reaction can be conducted in the presence of a plurality of soluble compaction oligonucleotides to immobilize the detached forward extension strands to the immobilized amplicons (see FIGS. 91-93).

Examples of strand displacing polymerases include phi29 DNA polymerase, large fragment of Bst DNA polymerase, large fragment of Bsu DNA polymerase (exo-), Bca DNA polymerase (exo-), Klenow fragment of E. coli DNA polymerase, T5 polymerase, M-MuLV reverse transcriptase, HIV viral reverse transcriptase, Deep Vent® DNA polymerase and KOD DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio).

In some embodiments, step (d) comprises: (i) removing the plurality of extended forward sequencing primer strand while retaining the immobilized concatemer template molecules; and (ii) contacting the plurality of retained immobilized concatemer molecules with a plurality of soluble amplification primers, a plurality of nucleotides (e.g., a second plurality of nucleotides) and a plurality of strand displacing polymerases, under a condition suitable to hybridize the plurality of soluble amplification primers to the plurality of retained immobilized concatemer template molecules and suitable for conducting a strand displacing primer extension reactions thereby generating a plurality of forward extension strands and a plurality of partially displaced forward extension strands that are hybridized to the immobilized concatemer template molecules, and a plurality of detached forward extension strands that are not hybridized to the immobilized concatemer template molecules. The soluble amplification primers hybridize with the soluble amplification primer binding sequence in the retained immobilized concatemer molecules (FIG. 91). The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine III). Inclusion of compaction oligonucleotides and/or hexamine (e.g., cobalt hexamine III) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 μm or smaller.

In some embodiments, step (d) comprises: (i) removing the plurality of extended forward sequencing primer strand while retaining the immobilized concatemer template molecules; and (ii) contacting the plurality of retained immobilized concatemer molecules with a plurality of soluble sequencing primers, a plurality of nucleotides (e.g., a second plurality of nucleotides) and a plurality of strand displacing polymerases, under a condition suitable to hybridize the plurality of soluble sequencing primers to the plurality of retained immobilized concatemer template molecules and suitable for conducting a strand displacing primer extension reactions thereby generating a plurality of forward extension strands and a plurality of partially displaced forward extension strands that are hybridized to the immobilized concatemer template molecules, and a plurality of detached forward extension strands that are not hybridized to the immobilized concatemer template molecules. The soluble forward sequencing primers hybridize with the forward sequencing primer binding sequence in the retained immobilized concatemer molecules. The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine III). Inclusion of compaction oligonucleotides and/or hexamine (e.g., cobalt hexamine III) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 µm or smaller.

In some embodiments, in step (d), the condition suitable to hybridize the plurality of soluble amplification primers to the plurality of retained immobilized single stranded nucleic acid concatemer template molecules comprises hybridizing the retained immobilized concatemer template molecules with the soluble amplification primers in the presence of a primer extension polymerase, a plurality of nucleotides, and a high efficiency hybridization buffer. In some embodiment, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50/a by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, in step (d), the plurality of extended forward sequencing primer strands can be removed using an enzyme or a chemical reagent. For example, the plurality of extended forward sequencing primer strands can be enzymatically degraded using a 5' to 3' double-stranded DNA exonuclease, including T7 exonuclease (e.g., from New England Biolabs, catalog #M0263S). In some embodiments, the plurality of extended forward sequencing primer strands can be removed with a temperature that favors nucleic acid denaturation.

In some embodiments, in step (d), a denaturation reagent can be used to remove the plurality of extended forward sequencing primer strands, wherein the denaturation reagent comprises any one or any combination of compounds such as formamide, acetonitrile, guanidinium chloride and/or a pH buffering agent (e.g., Tris-HCl, MES, HEPES, MOPS, or the like). Optionally, the denaturation reagent can further comprise PEG.

In some embodiments, in step (d), the plurality of extended forward sequencing primer strands can be removed using an elevated temperature (e.g., heat) with or without a nucleic acid denaturation reagent. The plurality of extended forward sequencing primer strands can be subjected to a temperature of about 45-50° C., or about 50-60° C., or about 60-70° C., or about 70-80° C., or about 80-90° C., or about 90-95° C., or higher temperature.

In some embodiments, in step (d), the plurality of extended forward sequencing primer strands can be removed using 100% formamide at a temperature of about 65° C. for about 3 minutes, and washing with a reagent comprising about 50 mM NaCl or equivalent ionic strength and having a pH of about 6.5-8.5.

In some embodiments, the pairwise sequencing method further comprises step (e): sequencing the plurality of immobilized partially displaced forward extension strands thereby generating a first plurality of extended reverse sequencing primer strands. In some embodiments, step (e) further comprises sequencing the plurality of immobilized detached forward extension strands thereby generating a second plurality of extended reverse sequencing primer strands. In some embodiments, individual immobilized partially displaced forward extension strands have two or more extended reverse sequencing primer strands hybridized thereon. In some embodiments, individual immobilized detached forward extension strands have two or more extended reverse sequencing primer strands hybridized thereon. During the sequencing of step (e), the immobilized partially displaced forward extension strands remain hybridized to the retained immobilized concatemer template molecules.

In some embodiments, the sequencing of step (e) comprises contacting the plurality of immobilized partially displaced forward extension strands (e.g., that are hybridized to the immobilized concatemer template molecules), and the plurality of immobilized detached forward extension strands, with a plurality of soluble reverse sequencing primers under a condition suitable to hybridize the reverse sequencing primers to the reverse sequencing primer binding site of the forward extension strands (FIG. 94). The sequencing of step (e) comprises conducting sequencing reactions using the hybridized reverse sequencing primers wherein the reverse sequencing reactions generates a plurality of extended reverse sequencing primer strands (FIG. 94). The extended reverse sequencing primer strands are hybridized to a partially displaced forward extension strand that is hybridized to the immobilized concatemer template molecules, or an immobilized detached forward extension strand.

For the sake of simplicity, FIGS. 88-94 do not show an immobilized concatemer template molecule having a universal binding sequence for a soluble compaction oligonucleotide. The skilled artisan will appreciate that the immobilized concatemer template molecule can include a universal binding sequence for a soluble compaction oligonucleotide.

For the sake of simplicity, FIG. 94 shows an exemplary immobilized partially displaced forward extension strand that is hybridized to the immobilized concatemer template molecule, and the immobilized detached forward extension strand, each having one copy of an extended reverse sequencing primer strand hybridized thereon. The skilled artisan will appreciate that the immobilized partially displaced forward extension strand that is hybridized to the immobilized concatemer template molecule, and the immobilized detached forward extension strand, can have two or more copies of the extended reverse sequencing primer strands hybridized thereon. Therefore, the reverse sequencing reaction can generate a plurality of extended reverse sequencing primer strands hybridized to the same immobilized partially displaced forward extension strand that is hybridized to the immobilized concatemer template molecule, or the immobilized detached forward extension strand.

In some embodiments, the reverse sequencing reaction can include a plurality of compaction oligonucleotides. The compaction oligonucleotides can serve to immobilize one or more of the detached forward extension strands via hybridization to the immobilized partially displaced forward extension strand (e.g., that is hybridized to the immobilized concatemer template molecule).

In some embodiments, in step (e), the condition that is suitable to hybridize the reverse sequencing primers to the reverse sequencing primer binding sequences of the immobilized partially displaced forward extension strand that is hybridized to the immobilized concatemer template molecule, and the immobilized detached forward extension strand, comprises contacting the plurality of soluble reverse sequencing primers and the forward extension strands with a high efficiency hybridization buffer. In some embodiments, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, the reverse sequencing reactions of step (e) comprises contacting the plurality of soluble reverse sequencing primers with the reverse sequencing primer binding sequences of the immobilized partially displaced forward extension strand that is hybridized to the immobilized concatemer template molecule, or the immobilized detached forward extension strand, with one or more types of sequencing polymerases, and a plurality of nucleotides and/or a plurality of multivalent molecules. In some embodiments, the soluble reverse sequencing primers comprise 3' OH extendible ends. In some embodiments, the soluble reverse sequencing primers comprise a 3' blocking moiety which can be removed to generate a 3' OH extendible end. In some embodiments, the soluble reverse sequencing primers lack a nucleotide having a scissile moiety. The sequencing reactions that employ nucleotides and/or multivalent molecules is described in more detail below. The reverse sequencing reactions can generate a plurality of extended reverse sequencing primer strands. In some embodiments, individual forward extension strands have multiple copies of the reverse sequencing primer binding sequences/sites, wherein each reverse sequencing primer binding site is capable of hybridizing to a reverse sequencing primer. Individual reverse sequencing primer binding sites in a given immobilized partially displaced forward extension strand that is hybridized to the immobilized concatemer template molecule, or immobilized detached forward extension strand, can be hybridized to a reverse sequencing primer and can undergo a sequencing reaction. Thus, an individual retained forward extension strand can undergo two or more sequence reactions, where each sequencing reaction is initiated from a reverse sequencing primer that is hybridized to a reverse sequencing primer binding site. In some embodiments, the sequencing reactions comprise a plurality of nucleotides (or analogs thereof) labeled with a detectable reporter moiety. In some embodiments, the sequencing reaction comprise a plurality of multivalent molecules having nucleotide units, where the multivalent molecules are labeled with a detectable reporter moiety. In some embodiments, the detectable reporter moiety comprises a fluorophore.

In some embodiments, the sequencing polymerases of step (e) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (e) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

In some embodiments, at least one washing step can be conducted after any of steps (a)-(e). The washing step can be conducted with a wash buffer comprising a pH buffering agent, a metal chelating agent, a salt, and a detergent.

In some embodiments, the pH buffering compound in the wash buffer comprises any one or any combination of two or more of Tris, Tris-HCl, Tricine, Bicine, Bis-Tris propane, HEPES, MES, MOPS, MOPSO, BES, TES, CAPS, TAPS, TAPSO, ACES, PIPES, ethanolamine (a.k.a 2-amino methanol; MEA), a citrate compound, a citrate mixture, NaOH and/or KOH. In some embodiments, the pH buffering agent can be present in the wash buffer at a concentration of about 1-100 mM, or about 10-50 mM, or about 10-25 mM. In some embodiments, the pH of the pH buffering agent which is present in any of the reagents described here in can be adjusted to a pH of about 4-9, or a pH of about 5-9, or a pH of about 5-8.

In some embodiments, the metal chelating agent in the wash buffer comprises EDTA (ethylenediaminetetraacetic acid), EGTA (ethylene glycol tetraacetic acid), HEDTA (hydroxyethylethylenediaminetriacetic acid), DPTA (diethylene triamine pentaacetic acid), NTA (N,N-bis(carboxymethyl)glycine), citrate anhydrous, sodium citrate, calcium citrate, ammonium citrate, ammonium bicitrate, citric acid, potassium citrate, or magnesium citrate. In some embodiments, the wash buffer comprises a chelating agent at a concentration of about 0.01-50 mM, or about 0.1-20 mM, or about 0.2-10 mM.

In some embodiments, the salt in the wash buffer comprises NaCl, KCl, $NH_2SO_4$ or potassium glutamate. In some embodiments, the detergent comprises an ionic detergent such as SDS (sodium dodecyl sulfate). The wash buffer can include a monovalent salt at a concentration of about 25-500 mM, or about 50-250 mM, or about 100-200 mM.

In some embodiments, the detergent in the wash buffer comprises a non-ionic detergent such as Triton X-100, Tween 20, Tween 80 or Nonidet P40. In some embodiments, the detergent comprises a zwitterionic detergent such as CHAPS (3-[(3-cholamidopropyl)dimethylammonio]-1-propanesulfonate) or N-Dodecyl-N,N-dimethyl-3-amonio-1-propanesulfate (DetX). In some embodiments, the detergent comprises LDS (lithium dodecyl sulfate), sodium taurodeoxycholate, sodium taurocholate, sodium glycocholate, sodium deoxycholate or sodium cholate. In some embodiments, the detergent is included in the wash buffer at a concentration of about 0.01-0.05%, or about 0.05-0.1%, or about 0.1-0.15%, or about 0.15-0.2%, or about 0.2-0.25%.

In Solution RCA and Pairwise Sequencing—Lacking Abasic Sites

The present disclosure provides pairwise sequencing methods, comprising step (a): contacting in-solution a plurality of single-stranded circular nucleic acid library molecules to a plurality of soluble first amplification primers, a plurality of a strand displacing polymerase, and a plurality of nucleotides which include any combination of dATP, dCTP, dGTP and/or dTTP, under a condition suitable to form a plurality of library-primer duplexes and suitable for conducting a rolling circle amplification reaction, thereby generating a plurality of single stranded nucleic acid concatemers (FIG. 95). The rolling circle amplification reaction includes a mixture of nucleotides that lack a scissile moiety that can be cleaved to generate an abasic site. Exemplary nucleotides having a scissile moiety include uridine, 8-oxo-7,8-dihydroguanine (e.g., 8oxoG) and deoxyinosine. The rolling circle amplification reaction generates a plurality of single stranded nucleic acid concatemers that lack a nucleotide having a scissile moiety. In some embodiments, the single-stranded circular nucleic acid library molecules comprise covalently closed circular molecules. In some embodiments, the soluble first amplification primer comprises a sequence that selectively hybridizes to a universal binding sequence in the circular nucleic acid library molecules, such as for example a universal binding sequence (or a complementary sequence thereof) for the first soluble amplification primer. Alternatively, the soluble first amplification primer comprises a random sequence that binds non-selectively to a sequence in the circular nucleic acid library molecules.

In some embodiments, individual single stranded circular nucleic acid library molecules in the plurality comprise a sequence of interest, and the individual immobilized concatemer template molecules further comprise any one or any combination of two or more of (i) a universal binding sequence (or complementary sequence thereof) for a soluble forward sequencing primer, (ii) a universal binding sequence (or complementary sequence thereof) for a soluble reverse sequencing primer, (iii) a universal binding sequence (or complementary sequence thereof) for an immobilized first surface primer, (iv) a universal binding sequence (or complementary sequence thereof) for an immobilized second surface primer, (v) a universal binding sequence (or complementary sequence thereof) for a first soluble amplification primer, (vi) a universal binding sequence (or complementary sequence thereof) for a second soluble amplification primer, (vii) a universal binding sequence (or complementary sequence thereof) for a soluble compaction oligonucleotide, (viii) a sample barcode sequence and/or (ix) a unique molecular index sequence.

In some embodiments, individual single stranded circular nucleic acid library molecules in the plurality comprise a sequence of interest and a universal binding sequence (or complementary sequence thereof) for a soluble compaction oligonucleotide, and the individual immobilized concatemer template molecules further comprise any one or any combination of two or more of (i) a universal binding sequence (or complementary sequence thereof) for a soluble forward sequencing primer, (ii) a universal binding sequence (or complementary sequence thereof) for a soluble reverse sequencing primer, (iii) a universal binding sequence (or complementary sequence thereof) for an immobilized first surface primer, (iv) a universal binding sequence (or complementary sequence thereof) for an immobilized second surface primer, (v) a universal binding sequence (or complementary sequence thereof) for a first soluble amplification primer, (vi) a universal binding sequence (or complementary sequence thereof) for a second soluble amplification primer, (vii) a sample barcode sequence and/or (viii) a unique molecular index sequence.

In some embodiments, the universal binding sequence (or a complementary sequence thereof) for the forward sequencing primer can hybridize to at least a portion of the forward sequencing primer. In some embodiments, the universal binding sequence (or a complementary sequence thereof) for the reverse sequencing primer can hybridize to at least a portion of the reverse sequencing primer. In some embodiments, the universal binding sequence (or a complementary sequence thereof) for the immobilized first surface primer can hybridize to at least a portion of the immobilized first surface primer. In some embodiments, the universal binding sequence (or a complementary sequence thereof) for the immobilized second surface primer can hybridize to at least a portion of the immobilized second surface primer. In some embodiments, the universal binding sequence (or a complementary sequence thereof) for the first soluble amplification primer can hybridize to at least a portion of the first soluble amplification primer. In some embodiments, the universal binding sequence (or a complementary sequence thereof) for the second soluble amplification primer can hybridize to at least a portion of the second soluble amplification primer. In some embodiments, the universal binding sequence (or a complementary sequence thereof) for the soluble compaction oligonucleotide can hybridize to at least a portion of the soluble compaction oligonucleotide.

In some embodiments, the rolling circle amplification reaction of step (a) generates a plurality of immobilized single stranded nucleic acid concatemer template molecules each comprising a concatemer lacking a nucleotide having a scissile moiety and two or more copies of a sequence of interest, and wherein the immobilized concatemer template molecules further comprise any one or any combination of two or more of: (i) two or more copies of a universal binding sequence (or a complementary sequence thereof) for a soluble forward sequencing primer, (ii) two or more copies of a universal binding sequence (or a complementary sequence thereof) for a soluble reverse sequencing primer, (iii) two or more copies of a universal binding sequence (or a complementary sequence thereof) for an immobilized first surface primer, (iv) two or more copies of a universal binding sequence (or a complementary sequence thereof) for an immobilized second surface primer, (v) two or more copies of a universal binding sequence (or a complementary sequence thereof) for a first soluble amplification primer, (vi) two or more copies of a universal binding sequence (or a complementary sequence thereof) for a second soluble amplification primer, (vii) two or more copies of a universal binding sequence (or a complementary sequence thereof) for a soluble compaction oligonucleotide, (viii) two or more copies of a sample barcode sequence and/or (ix) two or more copies of a unique molecular index sequence.

In some embodiments, the pairwise sequencing method further comprises step (b): distributing the rolling circle amplification reaction from step (a) onto a support having a plurality of the first surface primers immobilized thereon, under a condition suitable for hybridizing one or more portions of individual single stranded concatemers to one or more immobilized first surface primers (FIG. 96). In some embodiments, the immobilized first surface primers have terminal 3' group that are non-extendible. In some embodiments, the 3' terminal end of the immobilized first surface primers comprise a moiety that blocks primer extension, such as for example a phosphate group, a dideoxycytidine group, an inverted dT, or an amino group. In some embodiments, the immobilized first surface primer have an extendible 3'OH end. In some embodiments, the immobilized first surface primers lack a nucleotide having a scissile moiety. Exemplary nucleotides having a scissile moiety include uridine, 8-oxo-7,8-dihydroguanine (e.g., 8oxoG) and deoxyinosine. The concatemers are immobilized to the support by hybridization to the immobilized first surface primers. In some embodiments, the support comprises a plurality of first surface primers. In some embodiments, the support lacks a plurality of second surface primers. In some embodiments, the support comprises a plurality of first and second surface primers.

In some embodiments, the pairwise sequencing method further comprises step (c): continuing the rolling circle amplification reaction on the support to generate a plurality of extended concatemer template molecules that are immobilized via hybridization to the immobilized first surface primers (FIG. 97). The on-support RCA reaction can be conducted with a plurality of a strand displacing polymerase, and a plurality of nucleotides which include any combination of dATP, dCTP, dGTP and/or dTTP. The plurality of nucleotides lack a nucleotide having a scissile moiety. In some embodiments, the rolling circle amplification reaction on the support can be conducted in the presence of a plurality of compaction oligonucleotides.

In some embodiments, the immobilized first surface primers comprise single stranded oligonucleotides comprising DNA, RNA or a combination of DNA and RNA. The first surface primers comprise a sequence that is wholly complementary or partially complementary along their lengths to at least a portion of the concatemer molecules. In some embodiments, the first surface primers can lack a terminal 3' OH extendible end which renders the first surface primers non-extendible. In some embodiments, the first surface primers include a terminal 3' OH group which is extendible for nucleotide polymerization (e.g., polymerase catalyzed polymerization). The immobilized first surface primers can be immobilized to the support or immobilized to a coating on the support. The immobilized first surface primers can be embedded and attached (coupled) to the coating on the support. In some embodiments, the 5' end of the immobilized first surface primers are immobilized to a support or immobilized to a coating on the support. Alternatively, an interior portion or the 3' end of the immobilized first surface primers can be immobilized to a support or immobilized to a coating on the support. The support comprises a plurality of immobilized first surface primers having the same sequence. The immobilized first surface primers can be any length, for example 4-50 nucleotides, or 50-100 nucleotides, or 100-150 nucleotides, or longer lengths.

In some embodiments, the plurality of immobilized first surface primers comprise 3' extendible ends. In some embodiments, the 3' terminal end of the immobilized first surface primers comprise a moiety that blocks primer extension, such as for example a phosphate group, a dideoxycytidine group, an inverted dT, or an amino group. In some embodiments, the immobilized first surface primers are not extendible in a primer extension reaction. The immobilized first surface primers lack a nucleotide having a scissile moiety.

In some embodiments, the plurality of immobilized first surface primers comprise at least one phosphorothioate diester bond at their 5' ends which can render the first surface primers resistant to exonuclease degradation. In some embodiments, the plurality of immobilized first surface primers comprise 2-5 or more consecutive phosphorothioate diester bonds at their 5' ends. In some embodiments, the plurality of immobilized first surface primers comprise at least one ribonucleotide and/or at least one 2'-O-methyl or 2'-O-methoxyethyl (MOE) nucleotide which can render the first surface primers resistant to exonuclease degradation.

In some embodiments, the immobilized first surface primers comprise at least one locked nucleic acid (LNA) which comprises a methylene bridge bond between a 2' oxygen and 4' carbon of the pentose ring. Immobilized first surface primers that include at least one LNA can be resistant to nuclease digestions and can exhibit increased melting temperature when hybridized to the concatemer template molecules.

In some embodiments, the support further comprises a plurality of a second surface primer immobilized thereon (FIG. 86). The second surface primers have a sequence that differs from the first immobilized surface primer. The immobilized second surface primers comprise single stranded oligonucleotides comprising DNA, RNA or a combination of DNA and RNA. The second surface primers comprise a sequence that is wholly complementary or partially complementary along their lengths to at least a portion of a concatemer molecule. The immobilized second surface primers can be immobilized to the support or immobilized to a coating on the support. The immobilized second surface primers can be embedded and attached (coupled) to the coating on the support. In some embodiments, the 5' end of the immobilized second surface primers are immobilized to a support or immobilized to a coating on the support. Alternatively, an interior portion or the 3' end of the immobilized second surface primers can be immobilized to a support or immobilized to a coating on the support. The support comprises a plurality of immobilized second surface primers having the same sequence. The immobilized second surface primers can be any length, for example 4-50 nucleotides, or 50-100 nucleotides, or 100-150 nucleotides, or longer lengths.

In some embodiments, the 3' terminal end of the immobilized second surface primers comprise an extendible 3' OH moiety. In some embodiments, the 3' terminal end of the immobilized second surface primers comprise a 3' non-extendible moiety. The 3' terminal end of the immobilized second surface primers comprise a moiety that blocks primer extension, such as for example a phosphate group, a dideoxycytidine group, an inverted dT, or an amino group. The immobilized second surface primers are not extendible in a primer extension reaction. The immobilized second surface primers lack a nucleotide having a scissile moiety.

In some embodiments, the plurality of immobilized second surface primers comprise at least one phosphorothioate diester bond at their 5' ends which can render the second surface primers resistant to exonuclease degradation. In some embodiments, the plurality of immobilized second surface primers comprise 2-5 or more consecutive phosphorothioate diester bonds at their 5' ends. In some embodiments, the plurality of immobilized second surface primers comprise at least one ribonucleotide and/or at least one 2'-O-methyl or 2'-O-methoxyethyl (MOE) nucleotide which can render the second surface primers resistant to exonuclease degradation.

In some embodiments, individual immobilized single stranded nucleic acid concatemer template molecule are hybridized to an immobilized first surface primer, and at least one portion of the individual concatemer template molecule is hybridized to an immobilized second surface primer (FIG. 86). The immobilized second surface primers serve to pin down a portion of the immobilized concatemer template molecules to the support. The immobilized concatemer template molecule has two or more copies of a universal binding sequence for an immobilized second surface primer. The portion of the immobilized concatemer template molecule that includes the universal binding sequence for an immobilized second surface primer can hybridize to the immobilized second surface primer. In some embodiments, the second surface primers include a terminal 3' blocking group that renders them non-extendible. In some embodiments, the second surface primers have terminal 3' extendible ends.

In some embodiments, the support comprises about $10^2$-$10^{15}$ immobilized first surface primers per mm$^2$. In some embodiments, the support comprises about $10^2$-$10^{15}$ immobilized second surface primers per mm$^2$. In some embodiments, the support comprises about $10^2$-$10^{15}$ immobilized first surface primers and immobilized second surface primers per mm$^2$.

The immobilized surface primers (e.g., first and second surface primers) are in fluid communication with each other to permit flowing various solutions of linear or circular nucleic acid template molecules, soluble primers, enzymes, nucleotides, divalent cations, buffers, reagents, and the like, onto the support so that the plurality of immobilized surface primers react with the solutions in a massively parallel manner.

In some embodiments, the pairwise sequencing method further comprises step (d): sequencing the plurality of immobilized concatemer template molecules thereby generating a plurality of extended forward sequencing primer strands. The sequencing of step (d) comprises contacting the plurality of immobilized concatemer template molecules with a plurality of soluble forward sequencing primers under a condition suitable to hybridize at least one forward sequencing primer to at least one of the forward sequencing primer binding sites/sequences of the immobilized concatemer template molecules, and conducting forward sequencing reactions using one or more types of sequencing polymerases, a plurality of nucleotides and/or multivalent molecules, and the hybridized first forward sequencing primers. The forward sequencing reactions can generate a plurality of extended forward sequencing primer strands. In some embodiments, individual immobilized concatemer template molecules have multiple copies of the forward sequencing primer binding sites, wherein each forward sequencing primer binding site is capable of hybridizing to a first forward sequencing primer. Individual forward sequencing primer binding sites in a given immobilized concatemer template molecule can be hybridized to a forward sequencing primer and can undergo a sequencing reaction. Individual immobilized concatemer template molecules can undergo two or more sequence reactions, where each sequencing reaction is initiated from a first forward sequencing primer that is hybridized to a forward sequencing primer binding site (e.g., see FIG. 99). In some embodiments, the soluble forward sequencing primers comprise 3' OH extendible ends. In some embodiments, the soluble forward sequencing primers comprise a 3' blocking moiety which can be removed to generate a 3' OH extendible end. In some embodiments, the soluble forward sequencing primers lack a nucleotide having a scissile moiety. In some embodiments, the sequencing reactions comprise a plurality of nucleotides (or analogs thereof) labeled with a detectable reporter moiety. In some embodiments, the sequencing reaction comprise a plurality of multivalent molecules having a plurality of nucleotide units attached to a core, where the multivalent molecules are labeled with a detectable reporter moiety. In some embodiments, the core is labeled with a detectable reporter moiety. In some embodiments, at least one linker and/or at least one nucleotide unit of a nucleotide arm is labeled with a detectable reporter moiety. In some embodiments, the detectable reporter moiety comprises a fluorophore. An exemplary nucleotide arm is shown in FIG. 108, and exemplary multivalent molecules are shown in FIGS. 104-107.

In some embodiments, the sequencing polymerases of step (d) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (d) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

In some embodiments, the pairwise sequencing method further comprises step (e): retaining the plurality of immobilized concatemer template molecules and replacing the plurality of extended forward sequencing primer strands with a plurality of forward extension strands by conducting a primer extension reaction. The extended forward sequencing primer strands can be removed from the retained immobilized concatemer template molecules. The retained immobilized concatemer template molecule can be hybridized to a plurality of a second soluble amplification primers or a plurality of sequencing primers and subjected to a primer extension reaction. The primer extension reaction can be conducted with a plurality of soluble primers (e.g., second soluble amplification primers or soluble forward sequencing primers) and a plurality of strand-displacing polymerases to generate a plurality of forward extension strands that are hybridized to the immobilized concatemer template molecules, and a plurality of partially displaced forward extension strands that are hybridized to the immobilized concatemer template molecules to form a plurality of immobilized amplicons. The strand displacing primer extension reaction also generates a plurality of detached forward extension strands that are not hybridized to the immobilized concatemer template molecules. In some embodiments, the strand displacing primer extension reaction can be conducted in the presence of a plurality of soluble compaction oligonucleotides to immobilize the detached forward extension strands to the immobilized amplicons (see FIGS. 100-102).

Examples of strand displacing polymerases include phi29 DNA polymerase, large fragment of Bst DNA polymerase, large fragment of Bsu DNA polymerase (exo-), Bca DNA polymerase (exo-), Klenow fragment of *E. coli* DNA polymerase, T5 polymerase, M-MuLV reverse transcriptase, HIV viral reverse transcriptase, Deep Vent® DNA polymerase and KOD DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio).

In some embodiments, step (e) comprises: (i) removing the plurality of extended forward sequencing primer strand while retaining the immobilized concatemer template molecules; and (ii) contacting the plurality of retained immobilized concatemer molecules with a plurality of a second soluble amplification primers, a plurality of nucleotides (e.g., a second plurality of nucleotides) and a plurality of strand displacing polymerases, under a condition suitable to hybridize the plurality of second soluble amplification primers to the plurality of retained immobilized concatemer template molecules and suitable for conducting a strand displacing primer extension reactions thereby generating a plurality of forward extension strands and a plurality of partially displaced forward extension strands that are hybridized to the immobilized concatemer template molecules, and a plurality of detached forward extension strands that are not hybridized to the immobilized concatemer template molecules. The second soluble amplification primers hybridize with the second soluble amplification primer binding sequence in the retained immobilized concatemer molecules (FIG. 100). The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine III). Inclusion of compaction oligonucleotides and/or hexamine (e.g., cobalt hexamine III) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 µm or smaller.

In some embodiments, step (e) comprises: (i) removing the plurality of extended forward sequencing primer strand while retaining the immobilized concatemer template molecules; and (ii) contacting the plurality of retained immobilized concatemer molecules with a plurality of a second soluble sequencing primers, a plurality of nucleotides (e.g., a second plurality of nucleotides) and a plurality of strand displacing polymerases, under a condition suitable to hybridize the plurality of second soluble sequencing primers to the plurality of retained immobilized concatemer template molecules and suitable for conducting a strand displacing primer extension reactions thereby generating a plurality of forward extension strands and a plurality of partially displaced forward extension strands that are hybridized to the immobilized concatemer template molecules, and a plurality of detached forward extension strands that are not hybridized to the immobilized concatemer template molecules. The soluble forward sequencing primers hybridize with the forward sequencing primer binding sequence in the retained immobilized concatemer molecules. The primer extension reaction can optionally include a plurality of compaction oligonucleotides and/or hexamine (e.g., cobalt hexamine III) to generate forward extension strands. Individual forward extension strands can collapse into a nanoball having a more compact size and/or shape compared to a nanoball generated from a primer extension reaction conducted without compaction oligonucleotides and/or hexamine (e.g., cobalt hexamine III). Inclusion of compaction oligonucleotides and/or hexamine (e.g., cobalt hexamine III) in the primer extension reaction can improve FWHM (full width half maximum) of a spot image of the nanoball. The spot image can be represented as a Gaussian spot and the size can be measured as a FWHM. A smaller spot size as indicated by a smaller FWHM typically correlates with an improved image of the spot. In some embodiments, the FWHM of a nanoball spot can be about 10 µm or smaller.

In some embodiments, in step (e), the condition that is suitable to hybridize the plurality of second soluble amplification primers to the plurality of retained immobilized single stranded nucleic acid concatemer template molecules comprises hybridizing the retained immobilized concatemer template molecules with the soluble second amplification primers in the presence of a primer extension polymerase, a plurality of nucleotides, and a high efficiency hybridization buffer. In some embodiment, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, in step (e), the plurality of extended forward sequencing primer strands can be removed using an enzyme or a chemical reagent. For example, the plurality of extended forward sequencing primer strands can be enzymatically degraded using a 5' to 3' double-stranded DNA exonuclease, including T7 exonuclease (e.g., from New England Biolabs, catalog #M0263S). In some embodiments, the plurality of extended forward sequencing primer strands can be removed with a temperature that favors nucleic acid denaturation.

In some embodiments, in step (e), a denaturation reagent can be used to remove the plurality of extended forward sequencing primer strands, wherein the denaturation reagent comprises any one or any combination of compounds such as formamide, acetonitrile, guanidinium chloride and/or a pH buffering agent (e.g., Tris-HCl, MES, HEPES, MOPS, or the like). Optionally, the denaturation reagent can further comprise PEG.

In some embodiments, in step (e), the plurality of extended forward sequencing primer strands can be removed using an elevated temperature (e.g., heat) with or without a nucleic acid denaturation reagent. The plurality of extended forward sequencing primer strands can be subjected to a temperature of about 45-50° C., or about 50-60° C., or about 60-70° C., or about 70-80° C., or about 80-90° C., or about 90-95° C., or higher temperature.

In some embodiments, in step (e), the plurality of extended forward sequencing primer strands can be removed using 100% formamide at a temperature of about 65° C. for about 3 minutes, and washing with a reagent comprising about 50 mM NaCl or equivalent ionic strength and having a pH of about 6.5-8.5.

In some embodiments, the pairwise sequencing method further comprises step (f): sequencing the plurality of immobilized partially displaced forward extension strands thereby generating a first plurality of extended reverse sequencing primer strands. In some embodiments, step (f) further comprises sequencing the plurality of immobilized detached forward extension strands thereby generating a second plurality of extended reverse sequencing primer strands. In some embodiments, individual immobilized partially displaced forward extension strands have two or more extended reverse sequencing primer strands hybridized thereon. In some embodiments, individual immobilized detached forward extension strands have two or more extended reverse sequencing primer strands hybridized thereon. During the sequencing of step (f), the immobilized partially displaced forward extension strands remain hybridized to the retained immobilized concatemer template molecules.

In some embodiments, the sequencing of step (f) comprises contacting the plurality of immobilized partially displaced forward extension strands (e.g., that are hybridized to the immobilized concatemer template molecules), and the plurality of immobilized detached forward extension strands, with a plurality of soluble reverse sequencing primers under a condition suitable to hybridize the reverse sequencing primers to the reverse sequencing primer binding site of the forward extension strands (FIG. 103). The sequencing of step (f) comprises conducting sequencing reactions using the hybridized reverse sequencing primers wherein the reverse sequencing reactions generates a plurality of extended reverse sequencing primer strands (FIG. 103). The extended reverse sequencing primer strands are hybridized to a partially displaced forward extension strand that is hybridized to the immobilized concatemer template molecules, or an immobilized detached forward extension strand.

For the sake of simplicity, FIGS. 95-103 do not show an immobilized concatemer template molecule having a universal binding sequence for a soluble compaction oligonucleotide. The skilled artisan will appreciate that the immobilized concatemer template molecule can include a universal binding sequence for a soluble compaction oligonucleotide.

For the sake of simplicity, FIG. 103 shows an exemplary immobilized partially displaced forward extension strand that is hybridized to the immobilized concatemer template molecule, and the immobilized detached forward extension strand, each having one copy of an extended reverse sequencing primer strand hybridized thereon. The skilled artisan will appreciate that the immobilized partially displaced forward extension strand that is hybridized to the immobilized concatemer template molecule, and the immobilized detached forward extension strand, can have two or more copies of the extended reverse sequencing primer strands hybridized thereon. Therefore, the reverse sequencing reaction can generate a plurality of extended reverse sequencing primer strands hybridized to the same immobilized partially displaced forward extension strand that is hybridized to the immobilized concatemer template molecule, or the immobilized detached forward extension strand.

In some embodiments, the reverse sequencing reaction can include a plurality of compaction oligonucleotides. The compaction oligonucleotides can serve to immobilize one or more of the detached forward extension strands via hybridization to the immobilized partially displaced forward extension strand (e.g., that is hybridized to the immobilized concatemer template molecule).

In some embodiments, in step (f), the condition that is suitable to hybridize the reverse sequencing primers to the reverse sequencing primer binding sequences of the immobilized partially displaced forward extension strand that is hybridized to the immobilized concatemer template molecule, and the immobilized detached forward extension strand, comprises contacting the plurality of soluble reverse sequencing primers and the forward extension strands with a high efficiency hybridization buffer. In some embodiments, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, the reverse sequencing reactions of step (f) comprises contacting the plurality of soluble reverse sequencing primers with the reverse sequencing primer binding sequences of the immobilized partially displaced forward extension strand that is hybridized to the immobilized concatemer template molecule, or the immobilized detached forward extension strand, with one or more types of sequencing polymerases, and a plurality of nucleotides and/or a plurality of multivalent molecules. In some embodiments, the soluble reverse sequencing primers comprise 3' OH extendible ends. In some embodiments, the soluble reverse sequencing primers comprise a 3' blocking moiety which can be removed to generate a 3' OH extendible end. In some embodiments, the soluble reverse sequencing primers lack a nucleotide having a scissile moiety. The sequencing reactions that employ nucleotides and/or multivalent molecules is described in more detail below. The reverse sequencing reactions can generate a plurality of extended reverse sequencing primer strands. In some embodiments, individual forward extension strands have multiple copies of the reverse sequencing primer binding sequences/sites, wherein each reverse sequencing primer binding site is capable of hybridizing to a reverse sequencing primer. Individual reverse sequencing primer binding sites in a given immobilized partially displaced forward extension strand that is hybridized to the immobilized concatemer template molecule, or immobilized detached forward extension strand, can be hybridized to a reverse sequencing primer and can undergo a sequencing reaction. Thus, an individual retained forward extension strand can undergo two or more sequence reactions, where each sequencing reaction is initiated from a reverse sequencing primer that is hybridized to a reverse sequencing primer binding site. In some embodiments, the sequencing reactions comprise a plurality of nucleotides (or analogs thereof) labeled with a detectable reporter moiety. In some embodiments, the sequencing reaction comprise a plurality of multivalent molecules having nucleotide units, where the multivalent molecules are labeled with a detectable reporter moiety. In some embodiments, the detectable reporter moiety comprises a fluorophore.

In some embodiments, the sequencing polymerases of step (f) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (f) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

In some embodiments, at least one washing step can be conducted after any of steps (a)-(f). The washing step can be conducted with a wash buffer comprising a pH buffering agent, a metal chelating agent, a salt, and a detergent.

In some embodiments, the pH buffering compound in the wash buffer comprises any one or any combination of two or more of Tris, Tris-HCl, Tricine, Bicine, Bis-Tris propane, HEPES, MES, MOPS, MOPSO, BES, TES, CAPS, TAPS, TAPSO, ACES, PIPES, ethanolamine (a.k.a 2-amino methanol, MEA), a citrate compound, a citrate mixture, NaOH and/or KOH. In some embodiments, the pH buffering agent can be present in the wash buffer at a concentration of about 1-100 mM, or about 10-50 mM, or about 10-25 mM. In some embodiments, the pH of the pH buffering agent which is present in any of the reagents described here in can be adjusted to a pH of about 4-9, or a pH of about 5-9, or a pH of about 5-8.

In some embodiments, the metal chelating agent in the wash buffer comprises EDTA (ethylenediaminetetraacetic acid), EGTA (ethylene glycol tetraacetic acid), HEDTA (hydroxyethylethylenediaminetriacetic acid), DPTA (diethylene triamine pentaacetic acid), NTA (N,N-bis(carboxymethyl)glycine), citrate anhydrous, sodium citrate, calcium citrate, ammonium citrate, ammonium bicitrate, citric acid, potassium citrate, or magnesium citrate. In some embodiments, the wash buffer comprises a chelating agent at a concentration of about 0.01-50 mM, or about 0.1-20 mM, or about 0.2-10 mM.

In some embodiments, the salt in the wash buffer comprises NaCl, KCl, $NH_2SO_4$ or potassium glutamate. In some embodiments, the detergent comprises an ionic detergent such as SDS (sodium dodecyl sulfate). The wash buffer can include a monovalent salt at a concentration of about 25-500 mM, or about 50-250 mM, or about 100-200 mM.

In some embodiments, the detergent in the wash buffer comprises a non-ionic detergent such as Triton X-100, Tween 20, Tween 80 or Nonidet P-40. In some embodiments, the detergent comprises a zwitterionic detergent such as CHAPS (3-[(3-cholamidopropyl)dimethylammonio]-1-propanesulfonate) or N-Dodecyl-N,N-dimethyl-3-amonio-1-propanesulfate (DetX). In some embodiments, the detergent comprises LDS (lithium dodecyl sulfate), sodium taurodeoxycholate, sodium taurocholate, sodium glycocholate, sodium deoxycholate or sodium cholate. In some embodiments, the detergent is included in the wash buffer at a concentration of about 0.01-0.05%, or about 0.05-0.1%, or about 0.1-0.15%, or about 0.15-0.2%, or about 0.2-0.25%.

Introduction—Amplifying with Flexing Amplification Cycling

The present disclosure provides pairwise sequencing methods, comprising the general workflow: (a) providing a plurality of single stranded concatemer template molecule comprising at least one nucleotide having a scissile moiety, the concatemer template molecules being immobilized to a first surface primer which is immobilized on the support, and the support comprising a plurality of immobilized first and second surface primers, where the first surface primers comprise a nucleotide having a scissile moiety and the second surface primers lack a nucleotide having a scissile moiety; (b) sequencing at least a portion of the concatemer template molecules and removing the extension product of the sequencing reaction; (c) hybridizing a portion of individual concatemer template molecules to a second surface primer, and conducting a primer extension reaction to generate a plurality of forward extension strands that are covalently joined to the second surface primers; (d) dissociating the immobilized concatemer template molecules that are hybridized to the second surface primers and re-hybridizing a portion of individual concatemer template molecules to a second surface primer that is not covalently joined to a forward extension strand, by flowing onto the support a relaxing solution; (e) subjecting the immobilized concatemer template molecules and the immobilized forward extension strands to temperature dissociation and temperature re-hybridization conditions; (f) conducting an amplification reaction using the concatemer template molecules that are hybridized to a second surface primer to generate newly synthesized forward extension strands each being covalently joined to a second surface primer; (g) repeating steps (d)-(f) at least once, wherein steps (d)-(f) comprise a flexing amplification cycle; (h) generating abasic sites in the immobilized concatemer template molecules and the immobilized first surface primers, and cleaving the abasic sites to generate gap-containing nucleic acid molecules, thereby removing the immobilized concatemer template molecules and the immobilized first surface primers from the support while retaining the immobilized forward extension strands; and (i) sequencing the plurality of retained immobilized forward extension strands.

Methods for Pairwise Sequencing—Amplifying with Flexing Amplification Cycling

The present disclosure provides pairwise sequencing methods, comprising step (a): providing a plurality of immobilized single stranded nucleic acid concatemer template molecules each comprising at least one nucleotide having a scissile moiety that can be cleaved to generate an abasic site in the concatemer template molecule, wherein individual concatemer template molecules in the plurality are immobilized to a first surface primer that is immobilized to a support, wherein the immobilized first surface primers include a nucleotide having a scissile moiety, wherein the support further comprises a plurality of immobilized second surface primers which lack a nucleotide having a scissile moiety and have an extendible terminal 3'OH group. The immobilized concatemer template molecules comprise two or more copies of a sequence of interest, two or more copies of a universal binding sequence for an immobilized first surface primer, and two or more copies of a universal binding sequence for an immobilized second surface primer. The support can include an excess of immobilized first and second surface primers compared to the number of immobilized concatemer template molecules.

In some embodiment, the immobilized concatemer template molecule can self-collapse into a compact nucleic acid nanoball. The nanoballs can be imaged and a FWHM measurement can be obtained to give the shape/size of the nanoballs.

In some embodiments, individual immobilized concatemer template molecules are covalently joined to an immobilized surface primer (e.g., an immobilized first surface primer). In an alternative embodiment, individual immobilized concatemer template molecules are hybridized to an immobilized surface primer (e.g., an immobilized first surface primer).

In some embodiments, individual concatemer template molecules in the plurality comprise two or more copies of a sequence of interest, and wherein the individual immobilized concatemer template molecules further comprise any one or any combination of two or more of: (i) two or more copies of a universal binding sequence for a soluble forward sequencing primer, (ii) two or more copies of a universal binding sequence for a soluble reverse sequencing primer, (iii) two or more copies of a universal binding sequence for an immobilized first surface primer, (iv) two or more copies of a universal binding sequence for an immobilized second surface primer, (v) two or more copies of a universal binding sequence for a first soluble amplification primer, (vi) two or more copies of a universal binding sequence for a second soluble amplification primer, (vii) two or more copies of a universal binding sequence for a soluble compaction oligonucleotide, (viii) two or more copies of a sample barcode sequence and/or (ix) two or more copies of a unique molecular index sequence.

In some embodiments, the universal binding sequence (or a complementary sequence thereof) for the forward sequencing primer can hybridize to at least a portion of the forward sequencing primer. In some embodiments, the universal binding sequence (or a complementary sequence thereof) for the reverse sequencing primer can hybridize to at least a portion of the reverse sequencing primer. In some embodiments, the universal binding sequence (or a complementary sequence thereof) for the immobilized first surface primer can hybridize to at least a portion of the immobilized first surface primer. In some embodiments, the universal binding sequence (or a complementary sequence thereof) for the immobilized second surface primer can hybridize to at least a portion of the immobilized second surface primer. In some embodiments, the universal binding sequence (or a complementary sequence thereof) for the first soluble amplification primer can hybridize to at least a portion of the first soluble amplification primer. In some embodiments, the universal binding sequence (or a complementary sequence thereof) for the second soluble amplification primer can hybridize to at least a portion of the second soluble amplification primer. In some embodiments, the universal binding sequence (or a complementary sequence thereof) for the soluble compaction oligonucleotide can hybridize to at least a portion of the soluble compaction oligonucleotide.

In some embodiments, the scissile moiety in the immobilized concatemer template molecules and the immobilized first surface primers of step (a) can be converted into abasic sites. In some embodiments, the scissile moiety comprises uridine, 8-oxo-7,8-dihydroguanine (e.g., 8oxoG) or deoxyinosine. In the concatemer template molecules and the immobilized first surface primers, the uridine can be converted to an abasic site using uracil DNA glycosylase (UDG). In the concatemer template molecules and the immobilized first surface primers, the 8oxoG can be converted to an abasic site using FPG glycosylase. In the concatemer template molecules and the immobilized first surface primers, the deoxyinosine can be converted to an abasic site using AlkA glycosylase.

In some embodiments, the immobilized concatemer template molecules include 1-20, 20-40, 40-60, 60-80, 80-100, or a higher number of nucleotides with a scissile moiety. In some embodiments, about 0.1-1%, or about 1-5%, or about 5-10%, or about 10-20%, or about 20-30% or a higher percent of the dTTP in the immobilized concatemer template molecules are replaced with nucleotides having a scissile moiety. In some embodiments, the nucleotides having a scissile moiety are distributed at random positions along individual immobilized concatemer template molecules. In some embodiments, the nucleotides having a scissile moiety are distributed at different positions in the different immobilized concatemer template molecules. In some embodiments, the immobilized first surface primers include at least one and up to five nucleotides having a scissile moiety.

In some embodiments, the immobilized first surface primers comprise single stranded oligonucleotides comprising DNA, RNA or a combination of DNA and RNA. The immobilized first surface primers can be immobilized to the support or immobilized to a coating on the support. The immobilized first surface primers can be embedded and attached (coupled) to the coating on the support. In some embodiments, the 5' end of the immobilized first surface primers are immobilized to a support or immobilized to a coating on the support. Alternatively, an interior portion or the 3' end of the immobilized first surface primers can be immobilized to a support or immobilized to a coating on the support. The support comprises a plurality of immobilized first surface primers having the same sequence. The immobilized first surface primers can be any length, for example 4-50 nucleotides, or 50-100 nucleotides, or 100-150 nucleotides, or longer lengths. In some embodiments, the 3' terminal end of the immobilized first surface primers comprise an extendible 3' OH moiety. In some embodiments, the 3' terminal end of the immobilized first surface primers comprise a 3' non-extendible moiety.

In some embodiments, the plurality of immobilized first surface primers comprise at least one phosphorothioate diester bond at their 5' ends which can render the first surface primers resistant to exonuclease degradation. In some embodiments, the plurality of immobilized first surface primers comprise 2-5 or more consecutive phosphorothioate diester bonds at their 5' ends. In some embodiments, the plurality of immobilized first surface primers comprise at least one ribonucleotide and/or at least one 2'-O-methyl or 2'-O-methoxyethyl (MOE) nucleotide which can render the first surface primers resistant to exonuclease degradation.

In some embodiments, the immobilized first surface primers comprise at least one locked nucleic acid (LNA) which comprises a methylene bridge bond between a 2' oxygen and 4' carbon of the pentose ring. Immobilized first surface primers that include at least one LNA can be resistant to nuclease digestions and can exhibit increased melting temperature when hybridized to the forward extension strand.

In some embodiments, the immobilized concatemer template molecules further comprise two or more copies of a universal binding sequence (or complementary sequence thereof) for an immobilized second surface primer having a sequence that differs from the first immobilized surface primer. The immobilized second surface primers of step (a) comprise single stranded oligonucleotides comprising DNA, RNA or a combination of DNA and RNA. The immobilized second surface primers can be immobilized to the support or immobilized to a coating on the support. The immobilized second surface primers can be embedded and attached (coupled) to the coating on the support. In some embodiments, the 5' end of the immobilized second surface primers are immobilized to a support or immobilized to a coating on the support. Alternatively, an interior portion or the 3' end of the immobilized second surface primers can be immobilized to a support or immobilized to a coating on the support. The support comprises a plurality of immobilized second surface primers having the same sequence. The immobilized second surface primers can be any length, for example 4-50 nucleotides, or 50-100 nucleotides, or 100-150 nucleotides, or longer lengths.

In some embodiments, the 3' terminal end of the immobilized second surface primers comprise an extendible 3' OH moiety. In some embodiments, the 3' terminal end of the immobilized second surface primers comprise a 3' non-extendible moiety. In some embodiments, the 3' terminal end of the immobilized second surface primers comprise a moiety that blocks primer extension (e.g., non-extendible terminal 3' end), such as for example a phosphate group, a dideoxycytidine group, an inverted dT, or an amino group. The immobilized second surface primers are not extendible in a primer extension reaction. The immobilized second surface primers lack a nucleotide having a scissile moiety.

In some embodiments, the plurality of immobilized second surface primers comprise at least one phosphorothioate diester bond at their 5' ends which can render the second surface primers resistant to exonuclease degradation. In some embodiments, the plurality of immobilized second surface primers comprise 2-5 or more consecutive phosphorothioate diester bonds at their 5' ends. In some embodiments, the plurality of immobilized second surface primers comprise at least one ribonucleotide and/or at least one 2'-O-methyl or 2'-O-methoxyethyl (MOE) nucleotide which can render the second surface primers resistant to exonuclease degradation.

In some embodiments, the support comprises about $10^2$-$10^{15}$ immobilized first surface primers per mm$^2$. In some embodiments, the support comprises about $10^2$-$10^{15}$ immobilized second surface primers per mm$^2$. In some embodiments, the support comprises about $10^2$-$10^{15}$ immobilized first surface primers and immobilized second surface primers per mm$^2$.

The immobilized surface primers (e.g., first and second surface primers) are in fluid communication with each other to permit flowing various solutions of linear or circular nucleic acid template molecules, soluble primers, enzymes, nucleotides, divalent cations, buffers, reagents, and the like, onto the support so that the plurality of immobilized surface primers (and the primer extension products generated from the immobilized surface primers) react with the solutions in a massively parallel manner.

In some embodiments, the pairwise sequencing method further comprises step (b): sequencing the plurality of immobilized concatemer template molecules thereby generating a plurality of extended forward sequencing primer strands. The sequencing of step (b) comprises contacting the plurality of immobilized concatemer template molecules with a plurality of soluble forward sequencing primers under a condition suitable to hybridize at least one forward sequencing primer to at least one of the forward sequencing primer binding sites/sequences of the immobilized concatemer template molecules, and conducting forward sequencing reactions using one or more types of sequencing polymerases, a plurality of nucleotides and/or multivalent molecules, and the hybridized first forward sequencing primers. The forward sequencing reactions can generate a plurality of extended forward sequencing primer strands. In some embodiments, individual immobilized concatemer template molecules have multiple copies of the forward sequencing primer binding sites, wherein each forward sequencing primer binding site is capable of hybridizing to a first forward sequencing primer. Individual forward sequencing primer binding sites in a given immobilized concatemer template molecule can be hybridized to a forward sequencing primer and can undergo a sequencing reaction. Individual immobilized concatemer template molecules can undergo two or more sequence reactions, where each sequencing reaction is initiated from a first forward sequencing primer that is hybridized to a forward sequencing primer binding site. In some embodiments, the soluble forward sequencing primers comprise 3' OH extendible ends. In some embodiments, the soluble forward sequencing primers comprise a 3' blocking moiety which can be removed to generate a 3' OH extendible end. In some embodiments, the soluble forward sequencing primers lack a nucleotide having a scissile moiety. In some embodiments, the sequencing reactions comprise a plurality of nucleotides (or analogs thereof) labeled with a detectable reporter moiety. In some embodiments, the sequencing reaction comprise a plurality of multivalent molecules having a plurality of nucleotide units attached to a core, where the multivalent molecules are labeled with a detectable reporter moiety. In some embodiments, the core is labeled with a detectable reporter moiety. In some embodiments, at least one linker and/or at least one nucleotide unit of a nucleotide arm is labeled with a detectable reporter moiety. In some embodiments, the detectable reporter moiety comprises a fluorophore. An exemplary nucleotide arm is shown in FIG. 108, and exemplary multivalent molecules are shown in FIGS. 104-107. The sequencing reactions that employ nucleotides and/or multivalent molecules are described in more detail below.

In some embodiments, the sequencing polymerases of step (b) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (b) comprise engineered polymerases comprising at least 70%, 75%, 80%, 85%, 90%, 91%, 92%, 93%, 94%, 95%, 96%, 97%, 98%, 99%, or greater than 99%, sequence identity to any of SEQ ID NOS: 3-1315, 1317-2214, 2216-2366, 2368-2392, 2394-2407, 2409-2435, 2437-2454, 2456-2501 or 2511-2523.

In some embodiments, the sequencing of step (b) can be conducted in the presence or absence of a plurality of compaction oligonucleotides. The compaction oligonucleotides can retain the compact size and/or shape of the nanoballs (e.g., self-collapsed immobilized concatemer template molecules) during the forward sequencing reactions.

In some embodiments, the sequencing of step (b) can be conducted by contacting the plurality of immobilized concatemer template molecules with a plurality of forward sequencing primers in the presence of a hybridization solution comprising pH buffering agent, a sodium salt, and a chaotropic agent. Exemplary chaotropic agents include urea, guanidine hydrochloride and guanidine thiocyanate. In some embodiments, the hybridization solution comprises MES buffering agent, NaCl and guanidine hydrochloride.

In some embodiments, the sequencing of step (b) can be conducted by contacting the plurality of immobilized concatemer template molecules with a plurality of forward sequencing primers in the presence of a high efficiency hybridization buffer. In some embodiments, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, the pairwise sequencing method further comprises step (c): removing the extended forward sequencing primer strands and retaining the immobilized concatemer template molecules.

In some embodiments, in step (c), the plurality of extended forward sequencing primer strands can be removed using an enzyme or a chemical reagent. For example, the plurality of extended forward sequencing primer strands can be enzymatically degraded using a 5' to 3' double-stranded DNA exonuclease, including T7 exonuclease (e.g., from New England Biolabs, catalog #M0263S). In some embodiments, the plurality of extended forward sequencing primer strands can be removed with a temperature that favors nucleic acid denaturation.

In some embodiments, in step (c), a denaturation reagent can be used to remove the plurality of extended forward sequencing primer strands, wherein the denaturation reagent comprises any one or any combination of compounds such as formamide, acetonitrile, guanidinium chloride and/or a pH buffering agent (e.g., Tris-HCl, MES, HEPES, MOPS, or the like). Optionally, the denaturation reagent can further comprise PEG.

In some embodiments, in step (c), the plurality of extended forward sequencing primer strands can be removed using an elevated temperature (e.g., heat) with or without a nucleic acid denaturation reagent. The plurality of extended forward sequencing primer strands can be subjected to a temperature of about 45-50° C., or about 50-60° C., or about 60-70° C., or about 70-80° C., or about 80-90° C., or about 90-95° C., or higher temperature.

In some embodiments, in step (c), the plurality of extended forward sequencing primer strands can be removed using 100% formamide at a temperature of about 65° C. for about 3 minutes, and washing with a reagent comprising about 50 mM NaCl or equivalent ionic strength and having a pH of about 6.5-8.5.

In some embodiments, the pairwise sequencing method further comprises step (d): generating a first plurality of immobilized forward extension strands by hybridizing at least one portion of individual immobilized concatemer template molecules to a second surface primer and conducting a primer extension reaction from the second surface primers that are hybridized to a portion of the immobilized concatemer template molecule. The primer extension reaction generates a plurality of forward extension strands each having a sequence that is complementary to at least a portion of the immobilized concatemer template molecules. The primer extension reaction generates a plurality of forward extension strands that are covalently joined to an immobilized second surface primer.

In some embodiments, the primer extension reaction of step (d) comprises a plurality of nucleotides which lacks a nucleotide having a scissile moiety. For example, the plurality of nucleotides comprises dATP, dGTP, dCTP and dTTP. The primer extension reaction can be conducted at an isothermal temperature of about 50, 51, 52, 53, 54, 55, 56, 57, 58, 59, 60, 61, 62, 63, 64, 65, 66, 67 or 68° C.

The primer extension reaction of step (d) comprises a DNA polymerase capable of catalyzing a primer extension reaction using a uracil-containing template molecule (e.g., a uracil-tolerant polymerase). Exemplary polymerases include, but are not limited to, Q5U® Hot Start high-fidelity DNA polymerase (e.g., catalog #M0515S from New England Biolabs), Taq DNA polymerase, OneTaq® DNA polymerase (e.g., mixture of Taq and Deep Vent® DNA polymerases, catalog #M0480S from New England Biolabs), LongAmp® Taq DNA polymerase (e.g., catalog #M0323S from New England Biolabs), EpiMark® Hot Start Taq DNA polymerase (e.g., catalog #M0490S from New England Biolabs), Bst DNA polymerase (e.g., large fragment, catalog #M0275S from New England Biolabs), Bsu DNA polymerase (e.g., large fragment, catalog #M0330S from New England Biolabs), Phi29 DNA polymerase (e.g., catalog #M0269S from New England Biolabs), E. coli DNA polymerase (e.g., catalog #M0209S from New England Biolabs), Therminator™ DNA polymerase (e.g., catalog #M0261 S from New England Biolabs), Vent® DNA polymerase and Deep Vent® DNA polymerase.

The primer extension reaction of step (d) comprises a polymerase having strand displacing activity. Examples of strand displacing polymerases include phi29 DNA polymerase, large fragment of Bst DNA polymerase, large fragment of Bsu DNA polymerase (exo-), Bca DNA polymerase (exo-), Klenow fragment of E. coli DNA polymerase, T5 polymerase, M-MuLV reverse transcriptase, HIV viral reverse transcriptase, Deep Vent® DNA polymerase and KOD DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio)

The immobilized first and second surface primers, the immobilized concatemer template molecules, and the immobilized forward extension strands, are in fluid communication with each other to permit flowing various solutions of buffers and reagents, and the like, onto the support. The immobilized first and second surface primers, the immobilized concatemer template molecules, and the immobilized forward extension strands can react with the solutions in a massively parallel manner.

In some embodiments, the pairwise sequencing method further comprises step (e): contacting the plurality of immobilized concatemer template molecules and the plurality of immobilized forward extension strands with a relaxing solution. The relaxing solution can be flowed onto the support to permit reaction with the immobilized concatemer template molecules and the immobilized forward extension strands in a massively parallel manner. The relaxing solution can be flowed onto the support at a temperature of about 20-25° C.

The relaxing solution comprises at least one nucleic acid relaxing agent that can disrupt hydrogen bonding between the immobilized concatemer template molecules and the second surface primers. Exemplary relaxing agents include nucleic acid denaturants, chaotropic compounds, amide compounds, aprotic compounds, primary alcohols and ethylene glycol derivatives. Chaotropic compounds comprise urea, guanidine hydrochloride or guanidine thiocyanate. Amide compounds comprise formamide, acetamide or NN-dimethylformamide (DMF). Aprotic compounds comprise acetonitrile, DMSO (dimethyl sulfoxide), 1,4-dioxane or tetrahydrofuran. Primary alcohols comprise 1-propanol, ethanol or methanol. Ethylene glycol derivatives comprise 1,3-propanediol, ethylene glycol, glycerol, 1,2-dimethyoxyethane or 2-methoxyethanol. Other relaxing agents include sodium iodide, potassium iodide and polyamines.

The relaxing solution of step (e) can further comprise an ionic, non-ionic or zwitterion detergent. Exemplary ionic detergents include SDS (sodium dodecyl sulfate). Exemplary non-ionic detergents include Triton X-100, Tween 20, Tween 80 or Nonidet P-40. Exemplary zwitterionic detergent include CHAPS (3-[(3-cholamidopropyl)dimethylammonio]-1-propanesulfonate) or N-Dodecyl-N,N-dimethyl-3-amonio-1-propanesulfate (DetX). In some embodiments, the detergent comprises LDS (lithium dodecyl sulfate), sodium taurodeoxycholate, sodium taurocholate, sodium glycocholate, sodium deoxycholate or sodium cholate.

The relaxing solution of step (e) can further comprise a pH buffering compound (e g., zwitterionic buffering compound such as or 4-(2-hydroxyethyl)-1-piperazineethanesulfonic acid (HEPES)).

In some embodiments, the relaxing solution of step (e) comprises any one or a combination of two or more of a group selected from urea, guanidine hydrochloride, guanidine thiocyanate, formamide, acetamide, NN-dimethylformamide (DMF), acetonitrile, DMSO (dimethyl sulfoxide), 1,4-dioxane, tetrahydrofuran, 1-propanol, ethanol, methanol, 1,3-propanediol, ethylene glycol, glycerol, 1,2-dimethyoxyethane, 2-methoxyethanol, sodium iodide, potassium iodide and/or polyamines.

In some embodiments, the relaxing solution of step (e) comprises formamide and SSC. In some embodiments, the relaxing solution comprises acetonitrile, formamide and SSC. In some embodiments, the relaxing solution comprises acetonitrile, formamide and MES (2-(4-morpholino)-ethane sulfonic acid). In some embodiments, the relaxing solution comprises acetonitrile, formamide, guanidine hydrochloride and HEPES (4-(2-hydroxyethyl)-1-piperazineethanesulfonic acid) and a detergent (e.g., a zwitterion detergent such as Tween-20 or Tween-80). In some embodiments, the relaxing solution comprises acetonitrile, formamide, urea and HEPES. In some embodiments, the concentration of the SSC in the relaxing solution can be 1×, 2×, 3× or 4×.

In some embodiments, the pairwise sequencing method further comprises step (f): dissociating the at least one portion of the immobilized concatemer template molecules from the immobilized second surface primers and retaining the immobilized forward extension strands, and re-hybridizing at least one portion of the immobilized concatemer template molecules to one of the immobilized second surface primers that are not covalently joined to a forward extension strand. In some embodiments, the nucleic acid dissociating and re-hybridizing are conducted in the presence of the relaxing solution, and comprises a temperature ramp-up, a temperature plateau, and a temperature ramp-down (e.g., FIG. 117). The temperature ramp-up can start at about 20-25° C. and increase to about 55-70° C. The temperature plateau can be held at about 50-70° C. The temperature ramp-down can start at about 50-70° C. and decrease to about 20-25° C. The relaxing solution can be removed from the support by conducting at least one washing with a wash solution. The wash solution can include SSC (e.g., at any concentration of about 1-5×) and a detergent (e.g., Tween-20). A skilled artisan will recognize that the temperature ramp-up, temperature plateau, and temperature ramp-down conditions can be modified.

In some embodiments, the forward extension strands that are duplexed with the immobilized concatemer template molecules (e.g., generated in step (d)) can be denatured, and re-hybridized with a first surface primer, in the presence of the relaxing solution, the temperature ramp-up, temperature plateau, and temperature ramp-down.

In some embodiments, the pairwise sequencing method further comprises step (g): contacting the re-hybridized immobilized concatemer template molecules with an amplification solution and conducting a primer extension reaction from the second surface primers that are re-hybridized to a portion of the immobilized concatemer template molecules to generate a plurality of newly synthesized forward extension strands having a sequence that is complementary to at least a portion of the immobilized concatemer template molecules and are covalently joined to an immobilized second surface primer. The amplifying of step (g) is conducted after the temperature ramp-up, temperature plateau, temperature ramp-down, and washing of step (f) which is described above.

In some embodiments, the forward extension strands that are re-hybridized with a first surface primer (e.g., generated in step (f)), can be contacted with the amplification solution and subjected to a primer extension reaction to generate a plurality of newly synthesized concatemer template molecules when the plurality of immobilized first surface primers comprise a 3' extendible end. Alternatively, when the immobilized first surface primers comprise a 3' non-extendible end, then the amplification reaction will not generate newly synthesized concatemer template molecules.

In some embodiments, the amplification solution of step (g) comprises a plurality of nucleotides which lacks a nucleotide having a scissile moiety. For example, the plurality of nucleotides comprises dATP, dGTP, dCTP and dTTP. The amplification reaction can be conducted at an isothermal temperature of about 50, 51, 52, 53, 54, 55, 56, 57, 58, 59, 60, 61, 62, 63, 64, 65, 66, 67 or 68° C.

The amplification solution of step (g) comprises a DNA polymerase capable of catalyzing a primer extension reaction using a uracil-containing template molecule (e.g., a uracil-tolerant polymerase). Exemplary polymerases include, but are not limited to, Q5U® Hot Start high-fidelity DNA polymerase (e.g., catalog #M0515S from New England Biolabs), Taq DNA polymerase, OneTaq® DNA polymerase (e.g., mixture of Taq and Deep Vent® DNA polymerases, catalog #M0480S from New England Biolabs), LongAmp® Taq DNA polymerase (e.g., catalog #M0323S from New England Biolabs), EpiMark® Hot Start Taq DNA polymerase (e.g., catalog #M0490S from New England Biolabs), Bst DNA polymerase (e.g., large fragment, catalog #M0275S from New England Biolabs), Bsu DNA polymerase (e.g., large fragment, catalog #M0330S from New England Biolabs), Phi29 DNA polymerase (e.g., catalog #M0269S from New England Biolabs), E. coli DNA polymerase (e.g., catalog #M0209S from New England Biolabs), Therminator™ DNA polymerase (e.g., catalog #M0261S from New England Biolabs), Vent® DNA polymerase and Deep Vent® DNA polymerase.

The amplification solution of step (g) comprises a polymerase having strand displacing activity. Examples of strand displacing polymerases include phi29 DNA polymerase, large fragment of Bst DNA polymerase, large fragment of Bsu DNA polymerase (exo-), Bca DNA polymerase (exo-), Klenow fragment of E. coli DNA polymerase, T5 polymerase, M-MuLV reverse transcriptase, HIV viral reverse transcriptase, Deep Vent® DNA polymerase and KOD DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio).

In some embodiments, the pairwise sequencing method further comprises step (h): conducting a flexing amplification cycle by repeating steps (e)-(g) at least once. Steps (e)-(g) can be repeated once, twice, thrice, four times, five times, six times, or up to ten times. Each cycle can generate additional newly synthesized forward extension strands that are covalently joined to a second surface primer. Each cycle can generate additional newly synthesized concatemer template molecules that are covalently joined to a first surface primer. After conducting the desired number of flexing amplification cycles, step (i) can be conducted as described directly below.

In some embodiments, the pairwise sequencing method further comprises step (i): removing the immobilized concatemer template molecules by generating abasic sites in the immobilized single stranded concatemer template molecules and in the immobilized first surface primers at the nucleotide(s) having the scissile moiety, and generating gaps at the abasic sites thereby generating a plurality of gap-containing nucleic acid molecules while retaining the plurality of immobilized forward extension strands and retaining the plurality of immobilized second surface primers. The gap-containing nucleic acid molecules include the immobilized concatemer template strands and the immobilized first surface primers.

The abasic sites are generated on the concatemer template strands and the immobilized first surface primers that contain nucleotides having scissile moieties. In some embodiments, the scissile moieties in the concatemer template molecules comprises uridine, 8-oxo-7,8-dihydroguanine (e.g., 8oxoG) or deoxyinosine. The abasic sites can be removed to generate a plurality of concatemer template molecules and first surface primers having gaps while retaining the plurality of forward extension strands. The abasic sites can be generated by contacting the immobilized concatemer template molecules and the first surface primers with an enzyme that removes the nucleo-base at the nucleotide having the scissile moiety. The uracil in the concatemer template strands and the first surface primers can be converted to an abasic site using uracil DNA glycosylase (UDG). The 8oxoG in the concatemer template strands and the first surface primers can be converted to an abasic site using FPG glycosylase. The deoxyinosine in the concatemer template strands and the first surface primers can be converted to an abasic site using AlkA glycosylase.

In some embodiments, in step (i), the gaps can be generated by contacting the abasic sites with an enzyme or a mixture of enzymes having lyase activity that breaks the phosphodiester backbone at the 5' and 3' sides of the abasic site to release the base-free deoxyribose and generate a gap. The abasic sites can be removed using AP lyase, Endo IV endonuclease, FPG glycosylase/AP lyase, Endo VIII glycosylase/AP lyase. In some embodiments, generating the abasic sites and removal of the abasic sites to generate gaps can be achieved using a mixture of uracil DNA glycosylase and DNA glycosylase-lyase endonuclease VIII, for example USER™ (Uracil-Specific Excision Reagent Enzyme from New England Biolabs) or thermolabile USER™ (also from New England Biolabs).

In some embodiments, in step (i), the plurality of gap-containing template molecules can be removed using an enzyme, chemical and/or heat. After the gap-removal procedure, the plurality of immobilized forward extension strands that are covalently joined to the second surface primers are retained.

For example, the plurality of gap-containing template molecules can be enzymatically degraded using a 5' to 3' double-stranded DNA exonuclease, including T7 exonuclease (e.g., from New England Biolabs, catalog #M0263S).

In some embodiments, the plurality of gap-containing template molecules can be removed using a chemical reagent that favors nucleic acid denaturation. The denaturation reagent can include any one or any combination of compounds such as formamide, acetonitrile, guanidinium chloride and/or a buffering agent (e.g., Tris-HCl, MES, HEPES, or the like).

In some embodiments, the plurality of gap-containing template molecules can be removed using an elevated temperature (e.g., heat) with or without a nucleic acid denaturation reagent. The gap-containing template molecules can be subjected to a temperature of about 45-50° C., or about 50-60° C., or about 60-70° C., or about 70-80° C., or about 80-90° C., or about 90-95° C., or higher temperature.

In some embodiments, the plurality of gap-containing template molecules can be removed using 100% formamide at a temperature of about 65° C. for about 3 minutes, and washing with a reagent comprising about 50 mM NaCl or equivalent ionic strength and having a pH of about 6.5-8.5.

In some embodiments, the pairwise sequencing method further comprises step (j): sequencing the plurality of retained forward extension strands with a plurality of soluble reverse sequencing primers thereby generating a plurality of extended reverse sequencing primer strands. In some embodiments, the sequencing of step (e) comprises contacting the plurality of retained forward extension strands with a plurality of soluble reverse sequencing primers under a condition suitable to hybridize the reverse sequencing primers to the reverse sequencing primer binding site of the retained forward extension strands, and by conducting sequencing reactions using the hybridized reverse sequencing primers wherein the forward sequencing reactions generates a plurality of extended reverse sequencing primer strands.

Individual retained forward extension strands can include two or more copies of the reverse sequencing primer strands hybridized thereon. The reverse sequencing reaction can generate a plurality of extended reverse sequencing primer strands hybridized to the same retained forward extension strand.

In some embodiments, the sequencing of step (j) can be conducted in the presence or absence of a plurality of compaction oligonucleotides. The compaction oligonucleotides can retain the compact size and/or shape of the nanoballs (e.g., self-collapsed immobilized concatemer template molecules) during the reverse sequencing reactions.

In some embodiments, in step (j), the condition suitable to hybridize the reverse sequencing primers to the reverse sequencing primer binding sequences of the retained forward extension strands comprises contacting the plurality of soluble reverse sequencing primers and the retained forward extension strands with a hybridization solution comprising pH buffering agent, a sodium salt, and a chaotropic agent. Exemplary chaotropic agents include urea, guanidine hydrochloride and guanidine thiocyanate. In some embodiments, the hybridization solution comprises MES buffering agent, NaCl and guanidine hydrochloride.

In some embodiments, in step (j), the condition suitable to hybridize the reverse sequencing primers to the reverse sequencing primer binding sequences of the retained forward extension strands comprises contacting the plurality of soluble reverse sequencing primers and the retained forward extension strands with a high efficiency hybridization buffer. In some embodiments, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, the reverse sequencing reactions of step (j) comprises contacting the plurality of soluble reverse sequencing primers with the reverse sequencing primer binding sequences of the retained forward extension strands, one or more types of sequencing polymerases, and a plurality of nucleotides or a plurality of multivalent molecules. In some embodiments, the soluble reverse sequencing primers comprise 3' OH extendible ends. In some embodiments, the soluble reverse sequencing primers comprise a 3' blocking moiety which can be removed to generate a 3' OH extendible end. In some embodiments, the soluble reverse sequencing primers lack a nucleotide having a scissile moiety. The sequencing reactions that employ nucleotides and/or multivalent molecules are described in more detail below. The reverse sequencing reactions can generate a plurality of extended reverse sequencing primer strands. In some embodiments, individual retained forward extension strands have multiple copies of the reverse sequencing primer binding sequences/sites, wherein each reverse sequencing primer binding site is capable of hybridizing to a reverse sequencing primer. Individual reverse sequencing primer binding sites in a given retained forward extension strand can be hybridized to a reverse sequencing primer and can undergo a sequencing reaction. Thus, an individual retained forward extension strand can undergo two or more sequence reactions, where each sequencing reaction is initiated from a reverse sequencing primer that is hybridized to a reverse sequencing primer binding site. In some embodiments, the sequencing reactions comprise a plurality of nucleotides (or analogs thereof) labeled with a detectable reporter moiety. In some embodiments, the sequencing reaction comprise a plurality of multivalent molecules having nucleotide units, where the multivalent molecules are labeled with a detectable reporter moiety. In some embodiments, the detectable reporter moiety comprises a fluorophore. The sequencing reactions that employ nucleotides and/or multivalent molecules are described in more detail below.

In some embodiments, the sequencing polymerases of step (j) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (j) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

In some embodiments, at least one washing step can be conducted after any of steps (a)-(j). The washing step can be conducted with a wash solution comprising a pH buffering agent, a metal chelating agent, a salt, and a detergent.

In some embodiments, the pH buffering compound in the wash solution comprises any one or any combination of two or more of Tris, Tris-HCl, Tricine, Bicine, Bis-Tris propane, HEPES, MES, MOPS, MOPSO, BES, TES, CAPS, TAPS, TAPSO, ACES, PIPES, ethanolamine (a.k.a 2-amino methanol; MEA), a citrate compound, a citrate mixture, NaOH and/or KOH. In some embodiments, the pH buffering agent can be present in the wash solution at a concentration of about 1-100 mM, or about 10-50 mM, or about 10-25 mM. In some embodiments, the pH of the pH buffering agent which is present in any of the reagents described here in can be adjusted to a pH of about 4-9, or a pH of about 5-9, or a pH of about 5-8.

In some embodiments, the metal chelating agent in the wash solution comprises EDTA (ethylenediaminetetraacetic acid), EGTA (ethylene glycol tetraacetic acid), HEDTA (hydroxyethylethylenediaminetriacetic acid), DPTA (diethylene triamine pentaacetic acid), NTA (N,N-bis(carboxymethyl)glycine), citrate anhydrous, sodium citrate, calcium citrate, ammonium citrate, ammonium bicitrate, citric acid, potassium citrate, or magnesium citrate. In some embodiments, the wash solution comprises a chelating agent at a concentration of about 0.01-50 mM, or about 0.1-20 mM, or about 0.2-10 mM.

In some embodiments, the salt in the wash solution comprises NaCl, KCl, $NH_2SO_4$ or potassium glutamate. In some embodiments, the detergent comprises an ionic detergent such as SDS (sodium dodecyl sulfate). The wash solution can include a monovalent salt at a concentration of about 25-500 mM, or about 50-250 mM, or about 100-200 mM.

In some embodiments, the detergent in the wash solution comprises a non-ionic detergent such as Triton X-100, Tween 20, Tween 80 or Nonidet P-40. In some embodiments, the detergent comprises a zwitterionic detergent such as CHAPS (3-[(3-cholamidopropyl)dimethylammonio]-1-propanesulfonate) or N-Dodecyl-N,N-dimethyl-3-amonio-1-propanesulfate (DetX). In some embodiments, the detergent comprises LDS (lithium dodecyl sulfate), sodium taurodeoxycholate, sodium taurocholate, sodium glycocholate, sodium deoxycholate or sodium cholate. In some embodiments, the detergent is included in the wash solution at a concentration of about 0.01-0.05%, or about 0.05-0.1%, or about 0.1-0.15%, or about 0.15-0.2%, or about 0.2-0.25%.

The wash solution can include SSC (e.g., at any concentration of about 1-5×) and a detergent (e.g., Tween-20).

On Support RCA and Pairwise Sequencing—Amplifying with Flexing Amplification Cycling The present disclosure provides pairwise sequencing methods, comprising step (a): providing a support having a plurality of first and second surface primers immobilized thereon. The first surface primers have at least one nucleotide having a scissile moiety that can be cleaved to generate an abasic site. The second surface primers lack a nucleotide having a scissile moiety and have an extendible terminal 3'OH group.

In some embodiments, the scissile moiety in the immobilized first surface primers of step (a) can be converted into abasic sites. In some embodiments, the scissile moiety comprises uridine, 8-oxo-7,8-dihydroguanine (e.g., 8oxoG) or deoxyinosine. In the immobilized first surface primers, the uridine can be converted to an abasic site using uracil DNA glycosylase (UDG). In the immobilized first surface primers, the 8oxoG can be converted to an abasic site using FPG glycosylase. In the immobilized first surface primers, the deoxyinosine can be converted to an abasic site using AlkA glycosylase, the immobilized first surface primers comprise at least one and up to five nucleotides having a scissile moiety.

In some embodiments, the immobilized first surface primers comprise single stranded oligonucleotides comprising DNA, RNA or a combination of DNA and RNA. The immobilized first surface primers can be immobilized to the support or immobilized to a coating on the support. The immobilized first surface primers can be embedded and attached (coupled) to the coating on the support. In some embodiments, the 5' end of the immobilized first surface primers are immobilized to a support or immobilized to a coating on the support. Alternatively, an interior portion or the 3' end of the immobilized first surface primers can be immobilized to a support or immobilized to a coating on the support. The support comprises a plurality of immobilized first surface primers having the same sequence. The immobilized first surface primers can be any length, for example 4-50 nucleotides, or 50-100 nucleotides, or 100-150 nucleotides, or longer lengths. In some embodiments, the 3' terminal end of the immobilized first surface primers comprise an extendible 3' OH moiety. In some embodiments, the 3' terminal end of the immobilized first surface primers comprise a 3' non-extendible moiety.

In some embodiments, the plurality of immobilized first surface primers comprise at least one phosphorothioate diester bond at their 5' ends which can render the first surface primers resistant to exonuclease degradation. In some embodiments, the plurality of immobilized first surface primers comprise 2-5 or more consecutive phosphorothioate diester bonds at their 5' ends. In some embodiments, the plurality of immobilized first surface primers comprise at least one ribonucleotide and/or at least one 2'-O-methyl or 2'-O-methoxyethyl (MOE) nucleotide which can render the first surface primers resistant to exonuclease degradation.

In some embodiments, the immobilized first surface primers comprise at least one locked nucleic acid (LNA) which comprises a methylene bridge bond between a 2' oxygen and 4' carbon of the pentose ring. Immobilized first surface primers that include at least one LNA can be resistant to nuclease digestions and can exhibit increased melting temperature when hybridized to the forward extension strand.

In some embodiments, the immobilized concatemer template molecules further comprise two or more copies of a universal binding sequence (or complementary sequence thereof) for an immobilized second surface primer having a sequence that differs from the first immobilized surface primer. The immobilized second surface primers of step (a) comprise single stranded oligonucleotides comprising DNA, RNA or a combination of DNA and RNA. The immobilized second surface primers can be immobilized to the support or immobilized to a coating on the support. The immobilized second surface primers can be embedded and attached (coupled) to the coating on the support. In some embodiments, the 5' end of the immobilized second surface primers are immobilized to a support or immobilized to a coating on the support. Alternatively, an interior portion or the 3' end of the immobilized second surface primers can be immobilized to a support or immobilized to a coating on the support. The support comprises a plurality of immobilized second surface primers having the same sequence. The immobilized second surface primers can be any length, for example 4-50 nucleotides, or 50-100 nucleotides, or 100-150 nucleotides, or longer lengths.

In some embodiments, the 3' terminal end of the immobilized second surface primers comprise an extendible 3' OH moiety. In some embodiments, the 3' terminal end of the immobilized second surface primers comprise a 3' non-extendible moiety. In some embodiments, the 3' terminal end of the immobilized second surface primers comprise a moiety that blocks primer extension (e.g., non-extendible terminal 3' end), such as for example a phosphate group, a dideoxycytidine group, an inverted dT, or an amino group. The immobilized second surface primers are not extendible in a primer extension reaction. The immobilized second surface primers lack a nucleotide having a scissile moiety.

In some embodiments, the plurality of immobilized second surface primers comprise at least one phosphorothioate diester bond at their 5' ends which can render the second surface primers resistant to exonuclease degradation. In some embodiments, the plurality of immobilized second surface primers comprise 2-5 or more consecutive phosphorothioate diester bonds at their 5' ends. In some embodiments, the plurality of immobilized second surface primers comprise at least one ribonucleotide and/or at least one 2'-O-methyl or 2'-O-methoxyethyl (MOE) nucleotide which can render the second surface primers resistant to exonuclease degradation.

In some embodiments, the support comprises about $10^2$-$10^{15}$ immobilized first surface primers per $mm^2$. In some embodiments, the support comprises about $10^2$-$10^{15}$ immobilized second surface primers per $mm^2$. In some embodiments, the support comprises about $10^2$-$10^{15}$ immobilized first surface primers and immobilized second surface primers per $mm^2$.

The immobilized surface primers (e.g., first and second surface primers) are in fluid communication with each other to permit flowing various solutions of linear or circular nucleic acid template molecules, soluble primers, enzymes, nucleotides, divalent cations, buffers, reagents, and the like, onto the support so that the plurality of immobilized surface primers (and the primer extension products generated from the immobilized surface primers) react with the solutions in a massively parallel manner.

In some embodiments, the pairwise sequencing method further comprises step (b): generating a plurality of immobilized single stranded nucleic acid concatemer template molecules by hybridizing a plurality of single-stranded circular nucleic acid library molecules to the plurality of immobilized first surface primers and conducting a rolling circle amplification reaction with a plurality of a strand displacing polymerase, and a plurality of nucleotides which include dATP, dCTP, dGTP, dTTP and a plurality of nucleotides having a scissile moiety that can be cleaved to generate an abasic site, thereby generating a plurality of immobilized single stranded nucleic acid concatemer template molecules having at least one nucleotide with a scissile moiety, wherein individual single stranded nucleic acid concatemer template molecules are covalently joined to an immobilized first surface primer. The rolling circle amplification reaction can be conducted at an isothermal temperature of about 50, 51, 52, 53, 54, 55, 56, 57, 58, 59, 60, 61, 62, 63, 64, 65, 66, 67 or 68° C. In some embodiments, the rolling circle amplification reaction can be conducted in the presence, or in the absence, of a plurality of compaction oligonucleotides. In some embodiments, the support comprises an excess of immobilized first and second surface primers compared to the number of immobilized concatemer template molecules.

In some embodiments, the single-stranded circular nucleic acid library molecules comprise covalently closed circular molecules. In some embodiments, the single-stranded circular nucleic acid library molecules can be removed from the concatemer template molecules with at least one washing step which is conducted under a condition suitable to retain the single stranded nucleic acid concatemer template molecules where individual concatemer template molecules are operably joined to an immobilized first surface primer.

In some embodiments, each of the single stranded circular nucleic acid library molecules in the plurality comprise a sequence of interest, and wherein the individual immobilized concatemer template molecules further comprise any one or any combination of two or more of (i) a universal binding sequence (or complementary sequence thereof) for a soluble forward sequencing primer, (ii) a universal binding sequence (or complementary sequence thereof) for a soluble reverse sequencing primer, (iii) a universal binding sequence (or complementary sequence thereof) for an immobilized first surface primer, (iv) a universal binding sequence (or complementary sequence thereof) for an immobilized second surface primer, (v) a universal binding sequence (or complementary sequence thereof) for a first soluble amplification primer, (vi) a universal binding sequence (or complementary sequence thereof) for a second soluble amplification primer, (vii) a universal binding sequence (or complementary sequence thereof) for a soluble compaction oligonucleotide, (viii) a sample barcode sequence and/or (ix) a unique molecular index sequence.

In some embodiments, the universal binding sequence (or a complementary sequence thereof) for the forward sequencing primer can hybridize to at least a portion of the forward sequencing primer. In some embodiments, the universal binding sequence (or a complementary sequence thereof) for the reverse sequencing primer can hybridize to at least a portion of the reverse sequencing primer. In some embodiments, the universal binding sequence (or a complementary sequence thereof) for the immobilized first surface primer can hybridize to at least a portion of the immobilized first surface primer. In some embodiments, the universal binding sequence (or a complementary sequence thereof) for the immobilized second surface primer can hybridize to at least a portion of the immobilized second surface primer. In some embodiments, the universal binding sequence (or a complementary sequence thereof) for the first soluble amplification primer can hybridize to at least a portion of the first soluble amplification primer. In some embodiments, the universal binding sequence (or a complementary sequence thereof) for the second soluble amplification primer can hybridize to at least a portion of the second soluble amplification primer. In some embodiments, the universal binding sequence (or a complementary sequence thereof) for the soluble compaction oligonucleotide can hybridize to at least a portion of the soluble compaction oligonucleotide.

In some embodiments, the rolling circle amplification reaction of step (b) generates a plurality of immobilized single stranded nucleic acid concatemer template molecules each comprising a concatemer having at least one nucleotide having a scissile moiety and two or more copies of a sequence of interest, and wherein the immobilized concatemer template molecules further comprise any one or any combination of two or more of: (i) two or more copies of a universal binding sequence (or a complementary sequence thereof) for a soluble forward sequencing primer, (ii) two or more copies of a universal binding sequence (or a complementary sequence thereof) for a soluble reverse sequencing primer, (iii) two or more copies of a universal binding sequence (or a complementary sequence thereof) for an immobilized first surface primer, (iv) two or more copies of a universal binding sequence (or a complementary sequence thereof) for an immobilized second surface primer, (v) two or more copies of a universal binding sequence (or a complementary sequence thereof) for a first soluble amplification primer, (vi) two or more copies of a universal binding sequence (or a complementary sequence thereof) for a second soluble amplification primer, (vii) two or more copies of a universal binding sequence (or a complementary sequence thereof) for a soluble compaction oligonucleotide, (viii) two or more copies of a sample barcode sequence and/or (ix) two or more copies of a unique molecular index sequence.

The rolling circle amplification reaction of step (b) comprises a polymerase having strand displacing activity. Examples of strand displacing polymerases include phi29 DNA polymerase, large fragment of Bst DNA polymerase, large fragment of Bsu DNA polymerase (exo-), Bca DNA polymerase (exo-), Klenow fragment of *E. coli* DNA polymerase, T5 polymerase, M-MuLV reverse transcriptase, HIV viral reverse transcriptase, Deep Vent® DNA polymerase and KOD DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio)

The rolling circle amplification reaction of step (b) can be conducted with a nucleotide mixture containing dATP, dCTP, dGTP, dTTP and a nucleotide having a scissile moiety to generate immobilized concatemer template molecules which includes at least one nucleotide having a scissile moiety. The scissile moieties in the immobilized concatemer template molecules can be converted into abasic sites. In some embodiments, in the nucleotide mixture, the nucleotide having the scissile moiety comprises uridine, 8-oxo-7, 8-dihydroguanine (e.g., 8oxoG) or deoxyinosine. In the immobilized concatemer template molecules, the uridine can be converted to an abasic site using uracil DNA glycosylase (UDG), the 8oxoG can be converted to an abasic site using FPG glycosylase, and the deoxyinosine can be converted to an abasic site using AlkA glycosylase.

In some embodiments, the nucleotide mixture can include an amount of dUTP so that a target percent of the thymidine in the resulting concatemer molecules are replaced with dUTP. For example, when 30% of dTTP in the concatemer molecules are to be replaced with dUTP (e.g., 30% is the target percent) then the nucleotide mixture can contain 7.5% dUTP (e.g., 30/4=7.5%), 17.5% dTTP, and 25% each for dATP, dCTP and dGTP. The target percent of dTTP to be replaced by dUTP can be about 0.1-1%, or about 1-5%, or about 5-10%, or about 10-20%, or about 20-30%, or about 30-45%, or about 45-50%, or a higher percent of the dTTP in the immobilized concatemer template molecules are replaced with nucleotides having a scissile moiety.

In some embodiments, the nucleotide mixture can include an amount of deoxyinosine so that a target percent of the guanosine in the resulting concatemer molecules are replaced with deoxyinosine. For example, when 30% of dGTP in the concatemer molecules are to be replaced with deoxyinosine (e.g., 30% is the target percent) then the nucleotide mixture can contain 7.5% deoxyinosine (e.g., 30/4=7.5%), 17.5% dGTP, and 25% each for dATP, dCTP and dTTP. The target percent of dGTP to be replaced by deoxyinosine can be about 0.1-1%, or about 1-5%, or about 5-10%, or about 10-20%, or about 20-30%, or about 30-45%, or about 45-50%, or a higher percent of the dGTP in the immobilized concatemer template molecules are replaced with nucleotides having a scissile moiety.

In some embodiments, the nucleotide mixture can include an amount of 8oxoG so that a target percent of the guanosine in the resulting concatemer molecules are replaced with 8oxoG. For example, when 30% of dGTP in the concatemer molecules are to be replaced with 8oxoG (e.g., 30% is the target percent) then the nucleotide mixture can contain 7.5% 8oxoG (e.g., 30/4=7.5%), 17.5% dGTP, and 25% each for dATP, dCTP and dTTP. The target percent of dGTP to be replaced by 8oxoG can be about 0.1-1%, or about 1-5%, or about 5-10%, or about 10-20%, or about 20-30%, or about 30-45%, or about 45-50%, or a higher percent of the dGTP in the immobilized concatemer template molecules are replaced with nucleotides having a scissile moiety.

In some embodiments, the rolling circle amplification reaction generates immobilized concatemer template molecules with incorporated nucleotides having a scissile moiety that are distributed at random positions along individual immobilized concatemer template molecules. In some embodiments, the nucleotides having a scissile moiety are distributed at different positions in the different immobilized concatemer template molecules.

In some embodiment, the immobilized concatemer template molecule can self-collapse into a compact nucleic acid nanoball. The nanoballs can be imaged and a FWHM measurement can be obtained to give the shape/size of the nanoballs.

In some embodiments, the pairwise sequencing method further comprises step (c): sequencing the plurality of immobilized concatemer template molecules with a plurality of soluble forward sequencing primers thereby generating a plurality of extended forward sequencing primer strands, wherein individual immobilized concatemer template molecules have two or more extended forward sequencing primer strands hybridized thereon.

The sequencing of step (c) comprises contacting the plurality of immobilized concatemer template molecules with a plurality of soluble forward sequencing primers under a condition suitable to hybridize at least one forward sequencing primer to at least one of the forward sequencing primer binding sites/sequences of the immobilized concatemer template molecules, and conducting forward sequencing reactions using one or more types of sequencing polymerases, a plurality of nucleotides and/or multivalent molecules, and the hybridized first forward sequencing primers. In some embodiments, the soluble forward sequencing primers comprise 3' OH extendible ends. In some embodiments, the soluble forward sequencing primers comprise a 3' blocking moiety which can be removed to generate a 3' OH extendible end. In some embodiments, the soluble forward sequencing primers lack a nucleotide having a scissile moiety. The forward sequencing reactions can generate a plurality of extended forward sequencing primer strands. In some embodiments, individual immobilized concatemer template molecules have multiple copies of the forward sequencing primer binding sites, wherein each forward sequencing primer binding site is capable of hybridizing to a first forward sequencing primer. Individual forward sequencing primer binding sites in a given immobilized concatemer template molecule can be hybridized to a forward sequencing primer and can undergo a sequencing reaction. Individual immobilized concatemer template molecules can undergo two or more sequence reactions, where each sequencing reaction is initiated from a forward sequencing primer that is hybridized to a forward sequencing primer binding site. In some embodiments, the sequencing reactions comprise a plurality of nucleotides (or analogs thereof) labeled with a detectable reporter moiety. In some embodiments, the sequencing reaction comprise a plurality of multivalent molecules having a plurality of nucleotide units attached to a core, where the multivalent molecules are labeled with a detectable reporter moiety. In some embodiments, the core is labeled with a detectable reporter moiety. In some embodiments, at least one linker and/or at least one nucleotide unit of a nucleotide arm is labeled with a detectable reporter moiety. In some embodiments, the detectable reporter moiety comprises a fluorophore. An exemplary nucleotide arm is shown in FIG. 108, and exemplary multivalent molecules are shown in FIGS. 104-107. The sequencing reactions that employ nucleotides and/or multivalent molecules are described in more detail below.

In some embodiments, the sequencing polymerases of step (c) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (c) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

In some embodiments, the sequencing of step (c) can be conducted in the presence or absence of a plurality of compaction oligonucleotides. The compaction oligonucleotides can retain the compact size and/or shape of the nanoballs (e.g., self-collapsed immobilized concatemer template molecules) during the forward sequencing reactions.

In some embodiments, the sequencing of step (c) can be conducted by contacting the plurality of immobilized concatemer template molecules with a plurality of forward sequencing primers in the presence of a hybridization solution comprising pH buffering agent, a sodium salt, and a chaotropic agent. Exemplary chaotropic agents include urea, guanidine hydrochloride and guanidine thiocyanate. In some embodiments, the hybridization solution comprises MES buffering agent, NaCl and guanidine hydrochloride.

In some embodiments, the sequencing of step (c) can be conducted by contacting the plurality of immobilized concatemer template molecules with a plurality of forward sequencing primers in the presence of a high efficiency hybridization buffer. In some embodiments, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, the pairwise sequencing method further comprises step (d): removing the extended forward sequencing primer strands and retaining the immobilized concatemer template molecules.

In some embodiments, in step (d), the plurality of extended forward sequencing primer strands can be removed using an enzyme or a chemical reagent. For example, the plurality of extended forward sequencing primer strands can be enzymatically degraded using a 5' to 3' double-stranded DNA exonuclease, including T7 exonuclease (e.g., from New England Biolabs, catalog #M0263S). In some embodiments, the plurality of extended forward sequencing primer strands can be removed with a temperature that favors nucleic acid denaturation.

In some embodiments, in step (d), a denaturation reagent can be used to remove the plurality of extended forward sequencing primer strands, wherein the denaturation reagent comprises any one or any combination of compounds such as formamide, acetonitrile, guanidinium chloride and/or a pH buffering agent (e.g., Tris-HCl, MES, HEPES, MOPS, or the like). Optionally, the denaturation reagent can further comprise PEG.

In some embodiments, in step (d), the plurality of extended forward sequencing primer strands can be removed using an elevated temperature (e.g., heat) with or without a nucleic acid denaturation reagent. The plurality of extended forward sequencing primer strands can be subjected to a temperature of about 45-50° C., or about 50-60° C., or about 60-70° C., or about 70-80° C., or about 80-90° C., or about 90-95° C., or higher temperature.

In some embodiments, in step (d), the plurality of extended forward sequencing primer strands can be removed using 100% formamide at a temperature of about 65° C. for about 3 minutes, and washing with a reagent comprising about 50 mM NaCl or equivalent ionic strength and having a pH of about 6.5-8.5.

In some embodiments, the pairwise sequencing method further comprises step (e): generating a first plurality of immobilized forward extension strands by hybridizing at least one portion of individual immobilized concatemer template molecules to a second surface primer and conducting a primer extension reaction from the second surface primers that are hybridized to a portion of the immobilized concatemer template molecule. The primer extension reaction generates a plurality of forward extension strands each having a sequence that is complementary to at least a portion of the immobilized concatemer template molecules. The primer extension reaction generates a plurality of forward extension strands that are covalently joined to an immobilized second surface primer.

In some embodiments, the primer extension reaction of step (e) comprises a plurality of nucleotides which lacks a nucleotide having a scissile moiety. For example, the plurality of nucleotides comprises dATP, dGTP, dCTP and dTTP. The primer extension reaction can be conducted at an isothermal temperature of about 50, 51, 52, 53, 54, 55, 56, 57, 58, 59, 60, 61, 62, 63, 64, 65, 66, 67 or 68° C.

The primer extension reaction of step (e) comprises a DNA polymerase capable of catalyzing a primer extension reaction using a uracil-containing template molecule (e.g., a uracil-tolerant polymerase). Exemplary polymerases include, but are not limited to, Q5U® Hot Start high-fidelity DNA polymerase (e.g., catalog #M0515S from New England Biolabs), Taq DNA polymerase, OneTaq® DNA polymerase (e.g., mixture of Taq and Deep Vent® DNA polymerases, catalog #M0480S from New England Biolabs), LongAmp® Taq DNA polymerase (e.g., catalog #M0323S from New England Biolabs), EpiMark® Hot Start Taq DNA polymerase (e.g., catalog #M0490S from New England Biolabs), Bst DNA polymerase (e.g., large fragment, catalog #M0275S from New England Biolabs), Bsu DNA polymerase (e.g., large fragment, catalog #M0330S from New England Biolabs), Phi29 DNA polymerase (e.g., catalog #M0269S from New England Biolabs), E. coli DNA polymerase (e.g., catalog #M0209S from New England Biolabs), Therminator™ DNA polymerase (e.g., catalog #M0261S from New England Biolabs), Vent® DNA polymerase and Deep Vent® DNA polymerase.

The primer extension reaction of step (e) comprises a polymerase having strand displacing activity. Examples of strand displacing polymerases include phi29 DNA polymerase, large fragment of Bst DNA polymerase, large fragment of Bsu DNA polymerase (exo-), Bca DNA polymerase (exo-), Klenow fragment of E. coli DNA polymerase, T5 polymerase, M-MuLV reverse transcriptase, HIV viral reverse transcriptase, Deep Vent® DNA polymerase and KOD DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio)

The immobilized first and second surface primers, the immobilized concatemer template molecules, and the immobilized forward extension strands, are in fluid communication with each other to permit flowing various solutions of buffers and reagents, and the like, onto the support. The immobilized first and second surface primers, the immobilized concatemer template molecules, and the immobilized forward extension strands can react with the solutions in a massively parallel manner.

In some embodiments, the pairwise sequencing method further comprises step (f): contacting the plurality of immobilized concatemer template molecules and the plurality of immobilized forward extension strands with a relaxing solution. The relaxing solution can be flowed onto the support to permit reaction with the immobilized concatemer template molecules and the immobilized forward extension strands in a massively parallel manner. The relaxing solution can be flowed onto the support at a temperature of about 20-25° C.

The relaxing solution comprises at least one nucleic acid relaxing agent that can disrupt hydrogen bonding between the immobilized concatemer template molecules and the second surface primers. Exemplary relaxing agents include nucleic acid denaturants, chaotropic compounds, amide compounds, aprotic compounds, primary alcohols and ethylene glycol derivatives. Chaotropic compounds comprise urea, guanidine hydrochloride or guanidine thiocyanate. Amide compounds comprise formamide, acetamide or NN-dimethylformamide (DMF). Aprotic compounds comprise acetonitrile, DMSO (dimethyl sulfoxide), 1,4-dioxane or tetrahydrofuran. Primary alcohols comprise 1-propanol, ethanol or methanol. Ethylene glycol derivatives comprise 1,3-propanediol, ethylene glycol, glycerol, 1,2-dimethyoxyethane or 2-methoxyethanol. Other relaxing agents include sodium iodide, potassium iodide and polyamines.

The relaxing solution of step (f) can further comprise an ionic, non-ionic or zwitterion detergent. Exemplary ionic detergents include SDS (sodium dodecyl sulfate). Exemplary non-ionic detergents include Triton X-100, Tween 20, Tween 80 or Nonidet P-40. Exemplary zwitterionic detergent include CHAPS (3-[(3-cholamidopropyl)dimethylammonio]-1-propanesulfonate) or N-Dodecyl-N,N-dimethyl-3-amonio-1-propanesulfate (DetX). In some embodiments, the detergent comprises LDS (lithium dodecyl sulfate), sodium taurodeoxycholate, sodium taurocholate, sodium glycocholate, sodium deoxycholate or sodium cholate.

The relaxing solution of step (f) can further comprise a pH buffering compound (e.g., zwitterionic buffering compound such as or 4-(2-hydroxyethyl)-1-piperazineethanesulfonic acid (HEPES)).

In some embodiments, the relaxing solution of step (f) comprises any one or a combination of two or more of a group selected from urea, guanidine hydrochloride, guanidine thiocyanate, formamide, acetamide, NN-dimethylformamide (DMF), acetonitrile, DMSO (dimethyl sulfoxide), 1,4-dioxane, tetrahydrofuran, 1-propanol, ethanol, methanol, 1,3-propanediol, ethylene glycol, glycerol, 1,2-dimethyoxyethane, 2-methoxyethanol, sodium iodide, potassium iodide and/or polyamines.

In some embodiments, the relaxing solution of step (f) comprises formamide and SSC. In some embodiments, the relaxing solution comprises acetonitrile, formamide and SSC. In some embodiments, the relaxing solution comprises acetonitrile, formamide and MES (2-(4-morpholino)-ethane sulfonic acid). In some embodiments, the relaxing solution comprises acetonitrile, formamide, guanidine hydrochloride and HEPES (4-(2-hydroxyethyl)-1-piperazineethanesulfonic acid) and a detergent (e.g., a zwitterion detergent such as Tween-20 or Tween-80). In some embodiments, the relaxing solution comprises acetonitrile, formamide, urea and HEPES. In some embodiments, the concentration of the SSC in the relaxing solution can be 1×, 2×, 3× or 4×.

In some embodiments, the pairwise sequencing method further comprises step (g): dissociating the at least one portion of the immobilized concatemer template molecules from the immobilized second surface primers and retaining the immobilized forward extension strands, and re-hybridizing at least one portion of the immobilized concatemer template molecules to one of the immobilized second surface primers that are not covalently joined to a forward extension strand. In some embodiments, the nucleic acid dissociating and re-hybridizing are conducted in the presence of the relaxing solution, and comprises a temperature ramp-up, a temperature plateau, and a temperature ramp-down (e.g., FIG. 117). The temperature ramp-up can start at about 20-25° C. and increase to about 55-70° C. The temperature plateau can be held at about 50-70° C. The temperature ramp-down can start at about 50-70° C. and decrease to about 20-25° C. The relaxing solution can be removed from the support by conducting at least one washing with a wash solution. The wash solution can include SSC (e.g., at any concentration of about 1-5×) and a detergent (e.g., Tween-20). A skilled artisan will recognize that the temperature ramp-up, temperature plateau, and temperature ramp-down conditions can be modified.

In some embodiments, the forward extension strands that are duplexed with the immobilized concatemer template molecules (e.g., generated in step (e)) can be denatured, and re-hybridized with a first surface primer, in the presence of the relaxing solution, the temperature ramp-up, temperature plateau, and temperature ramp-down.

In some embodiments, the pairwise sequencing method further comprises step (h): contacting the re-hybridized immobilized concatemer template molecules with an amplification solution and conducting a primer extension reaction from the second surface primers that are re-hybridized to a portion of the immobilized concatemer template molecules to generate a plurality of newly synthesized forward extension strands having a sequence that is complementary to at least a portion of the immobilized concatemer template molecules and are covalently joined to an immobilized second surface primer. The amplifying of step (h) is conducted after the temperature ramp-up, temperature plateau, temperature ramp-down, and washing of step (g) which is described above.

In some embodiments, the forward extension strands that are re-hybridized with a first surface primer (e.g., generated in step (g)), can be contacted with the amplification solution and subjected to a primer extension reaction to generate a plurality of newly synthesized concatemer template molecules when the plurality of immobilized first surface primers comprise a 3' extendible end. Alternatively, when the immobilized first surface primers comprise a 3' non-extendible end, then the amplification reaction will not generate newly synthesized concatemer template molecules.

In some embodiments, the amplification solution of step (h) comprises a plurality of nucleotides which lacks a nucleotide having a scissile moiety. For example, the plurality of nucleotides comprises dATP, dGTP, dCTP and dTTP. The amplification reaction can be conducted at an isothermal temperature of about 50, 51, 52, 53, 54, 55, 56, 57, 58, 59, 60, 61, 62, 63, 64, 65, 66, 67 or 68° C.

The amplification solution of step (h) comprises a DNA polymerase capable of catalyzing a primer extension reaction using a uracil-containing template molecule (e.g., a uracil-tolerant polymerase). Exemplary polymerases include, but are not limited to, Q5U® Hot Start high-fidelity DNA polymerase (e.g., catalog #M0515S from New England Biolabs), Taq DNA polymerase, OneTaq® DNA polymerase (e.g., mixture of Taq and Deep Vent® DNA polymerases, catalog #M0480S from New England Biolabs), LongAmp® Taq DNA polymerase (e.g., catalog #M0323S from New England Biolabs), EpiMark® Hot Start Taq DNA polymerase (e.g., catalog #M0490S from New England Biolabs), Bst DNA polymerase (e.g., large fragment, catalog #M0275S from New England Biolabs), Bsu DNA polymerase (e.g., large fragment, catalog #M0330S from New England Biolabs), Phi29 DNA polymerase (e.g., catalog #M0269S from New England Biolabs), E. coli DNA polymerase (e.g., catalog #M0209S from New England Biolabs), Therminator™ DNA polymerase (e.g., catalog #M0261S from New England Biolabs), Vent® DNA polymerase and Deep Vent® DNA polymerase.

The amplification solution of step (h) comprises a polymerase having strand displacing activity. Examples of strand displacing polymerases include phi29 DNA polymerase, large fragment of Bst DNA polymerase, large fragment of Bsu DNA polymerase (exo-), Bca DNA polymerase (exo-), Klenow fragment of E. coli DNA polymerase, T5 polymerase, M-MuLV reverse transcriptase, HIV viral reverse transcriptase, Deep Vent® DNA polymerase and KOD DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio).

In some embodiments, the pairwise sequencing method further comprises step (i): conducting a flexing amplification cycle by repeating steps (f)-(h) at least once. Steps (f)-(h) can be repeated once, twice, thrice, four times, five times, six times, or up to ten times. Each cycle can generate additional newly synthesized forward extension strands that are covalently joined to a second surface primer. Each cycle can generate additional newly synthesized concatemer template molecules that are covalently joined to a first surface primer. After conducting the desired number of flexing amplification cycles, step (j) can be conducted as described directly below.

In some embodiments, the pairwise sequencing method further comprises step (j): removing the immobilized concatemer template molecules by generating abasic sites in the immobilized single stranded concatemer template molecules and in the immobilized first surface primers at the nucleotide(s) having the scissile moiety, and generating gaps at the abasic sites thereby generating a plurality of gap-containing nucleic acid molecules while retaining the plurality of immobilized forward extension strands and retaining the plurality of immobilized second surface primers. The gap-containing nucleic acid molecules include the immobilized concatemer template strands and the immobilized first surface primers.

The abasic sites are generated on the concatemer template strands and the immobilized first surface primers that contain nucleotides having scissile moieties. In some embodiments, the scissile moieties in the concatemer template molecules comprises uridine, 8-oxo-7,8-dihydroguanine (e.g., 8oxoG) or deoxyinosine. The abasic sites can be removed to generate a plurality of concatemer template molecules and first surface primers having gaps while retaining the plurality of forward extension strands. The abasic sites can be generated by contacting the immobilized concatemer template molecules and the first surface primers with an enzyme that removes the nucleo-base at the nucleotide having the scissile moiety. The uracil in the concatemer template strands and the first surface primers can be converted to an abasic site using uracil DNA glycosylase (UDG). The 8oxoG in the concatemer template strands and the first surface primers can be converted to an abasic site using FPG glycosylase. The deoxyinosine in the concatemer template strands and the first surface primers can be converted to an abasic site using AlkA glycosylase.

In some embodiments, in step (j), the gaps can be generated by contacting the abasic sites with an enzyme or a mixture of enzymes having lyase activity that breaks the phosphodiester backbone at the 5' and 3' sides of the abasic site to release the base-free deoxyribose and generate a gap. The abasic sites can be removed using AP lyase, Endo IV endonuclease, FPG glycosylase/AP lyase, Endo VIII glycosylase/AP lyase. In some embodiments, generating the abasic sites and removal of the abasic sites to generate gaps can be achieved using a mixture of uracil DNA glycosylase and DNA glycosylase-lyase endonuclease VIII, for example USER™ (Uracil-Specific Excision Reagent Enzyme from New England Biolabs) or thermolabile USER™ (also from New England Biolabs).

In some embodiments, in step (j), the plurality of gap-containing template molecules can be removed using an enzyme, chemical and/or heat. After the gap-removal procedure, the plurality of immobilized forward extension strands that are covalently joined to the second surface primers are retained.

For example, the plurality of gap-containing template molecules can be enzymatically degraded using a 5' to 3' double-stranded DNA exonuclease, including T7 exonuclease (e.g., from New England Biolabs, catalog #M0263S).

In some embodiments, the plurality of gap-containing template molecules can be removed using a chemical reagent that favors nucleic acid denaturation. The denaturation reagent can include any one or any combination of compounds such as formamide, acetonitrile, guanidinium chloride and/or a buffering agent (e.g., Tris-HCl, MES, HEPES, or the like).

In some embodiments, the plurality of gap-containing template molecules can be removed using an elevated temperature (e.g., heat) with or without a nucleic acid denaturation reagent. The gap-containing template molecules can be subjected to a temperature of about 45-50° C., or about 50-60° C., or about 60-70° C., or about 70-80° C., or about 80-90° C., or about 90-95° C., or higher temperature.

In some embodiments, the plurality of gap-containing template molecules can be removed using 100% formamide at a temperature of about 65° C. for about 3 minutes, and washing with a reagent comprising about 50 mM NaCl or equivalent ionic strength and having a pH of about 6.5-8.5.

In some embodiments, the pairwise sequencing method further comprises step (k): sequencing the plurality of retained forward extension strands with a plurality of soluble reverse sequencing primers thereby generating a plurality of extended reverse sequencing primer strands. In some embodiments, the sequencing of step (k) comprises contacting the plurality of retained forward extension strands with a plurality of soluble reverse sequencing primers under a condition suitable to hybridize the reverse sequencing primers to the reverse sequencing primer binding site of the retained forward extension strands, and by conducting sequencing reactions using the hybridized reverse sequencing primers wherein the forward sequencing reactions generates a plurality of extended reverse sequencing primer strands.

Individual retained forward extension strands can include two or more copies of the reverse sequencing primer strands hybridized thereon. The reverse sequencing reaction can generate a plurality of extended reverse sequencing primer strands hybridized to the same retained forward extension strand.

In some embodiments, the sequencing of step (k) can be conducted in the presence or absence of a plurality of compaction oligonucleotides. The compaction oligonucleotides can retain the compact size and/or shape of the nanoballs (e.g., self-collapsed immobilized concatemer template molecules) during the reverse sequencing reactions.

In some embodiments, in step (k), the condition suitable to hybridize the reverse sequencing primers to the reverse sequencing primer binding sequences of the retained forward extension strands comprises contacting the plurality of soluble reverse sequencing primers and the retained forward extension strands with a hybridization solution comprising pH buffering agent, a sodium salt, and a chaotropic agent. Exemplary chaotropic agents include urea, guanidine hydrochloride and guanidine thiocyanate. In some embodiments, the hybridization solution comprises MES buffering agent, NaCl and guanidine hydrochloride.

In some embodiments, in step (k), the condition suitable to hybridize the reverse sequencing primers to the reverse sequencing primer binding sequences of the retained forward extension strands comprises contacting the plurality of soluble reverse sequencing primers and the retained forward extension strands with a high efficiency hybridization buffer. In some embodiments, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10/a by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, the reverse sequencing reactions of step (k) comprises contacting the plurality of soluble reverse sequencing primers with the reverse sequencing primer binding sequences of the retained forward extension strands, one or more types of sequencing polymerases, and a plurality of nucleotides or a plurality of multivalent molecules. In some embodiments, the soluble reverse sequencing primers comprise 3' OH extendible ends. In some embodiments, the soluble reverse sequencing primers comprise a 3' blocking moiety which can be removed to generate a 3' OH extendible end. In some embodiments, the soluble reverse sequencing primers lack a nucleotide having a scissile moiety. The sequencing reactions that employ nucleotides and/or multivalent molecules are described in more detail below. The reverse sequencing reactions can generate a plurality of extended reverse sequencing primer strands. In some embodiments, individual retained forward extension strands have multiple copies of the reverse sequencing primer binding sequences/sites, wherein each reverse sequencing primer binding site is capable of hybridizing to a reverse sequencing primer. Individual reverse sequencing primer binding sites in a given retained forward extension strand can be hybridized to a reverse sequencing primer and can undergo a sequencing reaction. Thus, an individual retained forward extension strand can undergo two or more sequence reactions, where each sequencing reaction is initiated from a reverse sequencing primer that is hybridized to a reverse sequencing primer binding site. In some embodiments, the sequencing reactions comprise a plurality of nucleotides (or analogs thereof) labeled with a detectable reporter moiety. In some embodiments, the sequencing reaction comprise a plurality of multivalent molecules having nucleotide units, where the multivalent molecules are labeled with a detectable reporter moiety. In some embodiments, the detectable reporter moiety comprises a fluorophore. The sequencing reactions that employ nucleotides and/or multivalent molecules are described in more detail below.

In some embodiments, the sequencing polymerases of step (k) comprise engineered polymerases comprising at least 70%, 75%, 80%, 85%, 90%, 91%, 92%, 93%, 94%, 95%, 96%, 97%, 98%, 99%, or greater than 99%, sequence identity to any of SEQ ID NOS: 1, 2, 1316, 2215, 2367, 2393, 2408, 2436 or 2455.

In some embodiments, the sequencing polymerases of step (k) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

In some embodiments, at least one washing step can be conducted after any of steps (a)-(k). The washing step can be conducted with a wash solution comprising a pH buffering agent, a metal chelating agent, a salt, and a detergent.

In some embodiments, the pH buffering compound in the wash solution comprises any one or any combination of two or more of Tris, Tris-HCl, Tricine, Bicine, Bis-Tris propane, HEPES, MES, MOPS, MOPSO, BES, TES, CAPS, TAPS, TAPSO, ACES, PIPES, ethanolamine (a.k.a 2-amino methanol; MEA), a citrate compound, a citrate mixture, NaOH and/or KOH. In some embodiments, the pH buffering agent can be present in the wash solution at a concentration of about 1-100 mM, or about 10-50 mM, or about 10-25 mM. In some embodiments, the pH of the pH buffering agent which is present in any of the reagents described here in can be adjusted to a pH of about 4-9, or a pH of about 5-9, or a pH of about 5-8.

In some embodiments, the metal chelating agent in the wash solution comprises EDTA (ethylenediaminetetraacetic acid), EGTA (ethylene glycol tetraacetic acid), HEDTA (hydroxyethylethylenediaminetriacetic acid), DPTA (diethylene triamine pentaacetic acid), NTA (N,N-bis(carboxymethyl)glycine), citrate anhydrous, sodium citrate, calcium citrate, ammonium citrate, ammonium bicitrate, citric acid, potassium citrate, or magnesium citrate. In some embodiments, the wash solution comprises a chelating agent at a concentration of about 0.01-50 mM, or about 0.1-20 mM, or about 0.2-10 mM.

In some embodiments, the salt in the wash solution comprises NaCl, KCl, $NH_2SO_4$ or potassium glutamate. In some embodiments, the detergent comprises an ionic detergent such as SDS (sodium dodecyl sulfate). The wash solution can include a monovalent salt at a concentration of about 25-500 mM, or about 50-250 mM, or about 100-200 mM.

In some embodiments, the detergent in the wash solution comprises a non-ionic detergent such as Triton X-100, Tween 20, Tween 80 or Nonidet P-40. In some embodiments, the detergent comprises a zwitterionic detergent such as CHAPS (3-[(3-cholamidopropyl)dimethylammonio]-1-propanesulfonate) or N-Dodecyl-N,N-dimethyl-3-amonio-1-propanesulfate (DetX). In some embodiments, the detergent comprises LDS (lithium dodecyl sulfate), sodium taurodeoxycholate, sodium taurocholate, sodium glycocholate, sodium deoxycholate or sodium cholate. In some embodiments, the detergent is included in the wash solution at a concentration of about 0.01-0.05%, or about 0.05-0.1%, or about 0.1-0.15%, or about 0.15-0.2%, or about 0.2-0.25%.

The wash solution can include SSC (e.g., at any concentration of about 1-5×) and a detergent (e.g., Tween-20).

In-Solution RCA and Pairwise Sequencing—Amplifying with Flexing Amplification Cycling The present disclosure provides pairwise sequencing methods, comprising step (a): contacting in-solution a plurality of single-stranded circular nucleic acid library molecules to a plurality of soluble first amplification primers, a plurality of a strand displacing polymerase, and a plurality of nucleotides which include dATP, dCTP, dGTP, dTTP and a nucleotide having a scissile moiety, under a condition suitable to form a plurality of library-primer duplexes and suitable for conducting a rolling circle amplification reaction, thereby generating a plurality of single stranded nucleic acid concatemers having at least one nucleotide with a scissile moiety. The in-solution rolling circle amplification reaction can be conducted at an isothermal temperature of about 50, 51, 52, 53, 54, 55, 56, 57, 58, 59, 60, 61, 62, 63, 64, 65, 66, 67 or 68° C.

In some embodiments, the soluble first amplification primer comprises a sequence that selectively hybridizes to a universal binding sequence in the circular nucleic acid library molecules, such as for example a universal binding sequence (or a complementary sequence thereof) for the first soluble amplification primer. Alternatively, the soluble first amplification primer comprises a random sequence that binds non-selectively to a sequence in the circular nucleic acid library molecules.

In some embodiments, individual single stranded circular nucleic acid library molecules in the plurality comprises a sequence of interest and wherein the individual library molecules further comprise any one or any combination of two or more of (i) a universal binding sequence (or a complementary sequence thereof) for a soluble forward sequencing primer, (ii) a universal binding sequence (or a complementary sequence thereof) for a soluble reverse sequencing primer, (iii) a universal binding sequence (or a complementary sequence thereof) for an immobilized first surface primer, (iv) a universal binding sequence (or a complementary sequence thereof) for an immobilized second surface primer, (v) a universal binding sequence (or a complementary sequence thereof) for a first soluble amplification primer, (vi) a universal binding sequence (or a complementary sequence thereof) for a second soluble amplification primer, (vii) a universal binding sequence (or a complementary sequence thereof) for a soluble compaction oligonucleotide, (viii) a sample barcode sequence and/or (ix) a unique molecular index sequence. In some embodiments, the single-stranded circular nucleic acid library molecules comprise covalently closed circular molecules.

In some embodiments, the rolling circle amplification reaction of step (a) generates a plurality of single stranded nucleic acid concatemer molecules in solution, comprising a concatemer having at least one nucleotide having a scissile moiety. In some embodiments, individual concatemer template molecules in the plurality comprise two or more copies of a sequence of interest, and wherein the individual immobilized concatemer template molecules further comprise any one or any combination of two or more of: (i) two or more copies of a universal binding sequence for a soluble forward sequencing primer, (ii) two or more copies of a universal binding sequence for a soluble reverse sequencing primer, (iii) two or more copies of a universal binding sequence for an immobilized first surface primer, (iv) two or more copies of a universal binding sequence for an immobilized second surface primer, (v) two or more copies of a universal binding sequence for a first soluble amplification primer, (vi) two or more copies of a universal binding sequence for a second soluble amplification primer, (vii) two or more copies of a universal binding sequence for a soluble compaction oligonucleotide, (viii) two or more copies of a sample barcode sequence and/or (ix) two or more copies of a unique molecular index sequence.

In some embodiments, the universal binding sequence (or a complementary sequence thereof) for the forward sequencing primer can hybridize to at least a portion of the forward sequencing primer. In some embodiments, the universal binding sequence (or a complementary sequence thereof) for the reverse sequencing primer can hybridize to at least a portion of the reverse sequencing primer. In some embodiments, the universal binding sequence (or a complementary sequence thereof) for the immobilized first surface primer can hybridize to at least a portion of the immobilized first surface primer. In some embodiments, the universal binding sequence (or a complementary sequence thereof) for the immobilized second surface primer can hybridize to at least a portion of the immobilized second surface primer. In some embodiments, the universal binding sequence (or a complementary sequence thereof) for the first soluble amplification primer can hybridize to at least a portion of the first soluble amplification primer. In some embodiments, the universal binding sequence (or a complementary sequence thereof) for the second soluble amplification primer can hybridize to at least a portion of the second soluble amplification primer. In some embodiments, the universal binding sequence (or a complementary sequence thereof) for the soluble compaction oligonucleotide can hybridize to at least a portion of the soluble compaction oligonucleotide.

The rolling circle amplification reaction of step (a) comprises a polymerase having strand displacing activity. Examples of strand displacing polymerases include phi29 DNA polymerase, large fragment of Bst DNA polymerase, large fragment of Bsu DNA polymerase (exo-), Bca DNA polymerase (exo-), Klenow fragment of E. coli DNA polymerase, T5 polymerase, M-MuLV reverse transcriptase, HIV viral reverse transcriptase, Deep Vent® DNA polymerase and KOD DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio)

The in-solution rolling circle amplification reaction of step (a) can be conducted with a nucleotide mixture containing dATP, dCTP, dGTP, dTTP and a nucleotide having a scissile moiety to generate the concatemer molecules which includes at least one nucleotide having a scissile moiety. The scissile moieties in the concatemer molecules can be converted into abasic sites. In some embodiments, in the nucleotide mixture, the nucleotide having the scissile moiety comprises uridine, 8-oxo-7,8-dihydroguanine (e.g., 8oxoG) or deoxyinosine. In the concatemer molecules, the uridine can be converted to an abasic site using uracil DNA glycosylase (UDG), the 8oxoG can be converted to an abasic site using FPG glycosylase, and the deoxyinosine can be converted to an abasic site using AlkA glycosylase.

In some embodiments, the nucleotide mixture can include an amount of dUTP so that a target percent of the thymidine in the resulting concatemer molecules are replaced with dUTP. For example, when 30% of dTTP in the concatemer molecules are to be replaced with dUTP (e.g., 30% is the target percent) then the nucleotide mixture can contain 7.5% dUTP (e.g., 30/4=7.5%), 17.5% dTTP, and 25% each for dATP, dCTP and dGTP. The target percent of dTTP to be replaced by dUTP can be about 0.1-1%, or about 1-5%, or about 5-10%, or about 10-20%, or about 20-30%, or about 30-45%, or about 45-50%, or a higher percent of the dTTP in the concatemer molecules are replaced with nucleotides having a scissile moiety.

In some embodiments, the nucleotide mixture can include an amount of deoxyinosine so that a target percent of the guanosine in the resulting concatemer molecules are replaced with deoxyinosine. For example, when 30% of dGTP in the concatemer molecules are to be replaced with deoxyinosine (e.g., 30% is the target percent) then the nucleotide mixture can contain 7.5% deoxyinosine (e.g., 30/4=7.5%), 17.5% dGTP, and 25% each for dATP, dCTP and dTTP. The target percent of dGTP to be replaced by deoxyinosine can be about 0.1-1%, or about 1-5%, or about 5-10%, or about 10-20%, or about 20-30%, or about 30-45%, or about 45-50%, or a higher percent of the dGTP in the concatemer molecules are replaced with nucleotides having a scissile moiety.

In some embodiments, the nucleotide mixture can include an amount of 8oxoG so that a target percent of the guanosine in the resulting concatemer molecules are replaced with 8oxoG. For example, when 30% of dGTP in the concatemer molecules are to be replaced with 8oxoG (e.g., 30% is the target percent) then the nucleotide mixture can contain 7.5% 8oxoG (e.g., 30/4=7.5%), 17.5% dGTP, and 25% each for dATP, dCTP and dTTP. The target percent of dGTP to be replaced by 8oxoG can be about 0.1-1%, or about 1-5%, or about 5-10%, or about 10-20%, or about 20-30%, or about 30-45%, or about 45-50%, or a higher percent of the dGTP in the concatemer molecules are replaced with nucleotides having a scissile moiety.

In some embodiments, the in-solution rolling circle amplification reaction generates concatemer molecules with incorporated nucleotides having a scissile moiety that are distributed at random positions along individual immobilized concatemer template molecules. In some embodiments, the nucleotides having a scissile moiety are distributed at different positions in the different concatemer molecules.

In some embodiments, the pairwise sequencing method further comprises step (b): distributing the rolling circle amplification reaction from step (a) onto a support having a plurality of the first and second surface primers immobilized thereon, under a condition suitable for hybridizing one or more portions of individual single stranded concatemers to one or more immobilized first surface primers. In some embodiments, the immobilized first surface primers include at least one nucleotide having a scissile moiety. In some embodiments, the immobilized second surface primers lack a nucleotide having a scissile moiety and have an extendible 3'OH group.

In some embodiments, the distributing of step (b) can be conducted in the presence of a hybridization solution comprising pH buffering agent, a sodium salt, and a chaotropic agent. Exemplary chaotropic agents include urea, guanidine hydrochloride and guanidine thiocyanate. In some embodiments, the hybridization solution comprises MES buffering agent, NaCl and guanidine hydrochloride.

In some embodiments, the distributing of step (b) can be conducted in the presence of a high efficiency hybridization buffer. In some embodiments, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, the pairwise sequencing method further comprises step (c): continuing the rolling circle amplification reaction on the support to generate a plurality of extended concatemer template molecules that are immobilized via hybridization to the immobilized first surface primers. The on-support RCA reaction can be conducted with a plurality of a strand displacing polymerase, and a plurality of nucleotides which include dATP, dCTP, dGTP, dTTP and a nucleotide having a scissile moiety, under a condition suitable to generate a plurality of extended concatemers having at least one nucleotide with a scissile moiety. In some embodiments, the rolling circle amplification reaction on the support can be conducted in the presence, or in the absence, of a plurality of compaction oligonucleotides. The rolling circle amplification reaction on the support can be conducted at an isothermal temperature of about 50, 51, 52, 53, 54, 55, 56, 57, 58, 59, 60, 61, 62, 63, 64, 65, 66, 67 or 68° C.

The rolling circle amplification reaction of step (c) continues on the support using a polymerase having strand displacing activity. Examples of strand displacing polymerases include phi29 DNA polymerase, large fragment of Bst DNA polymerase, large fragment of Bsu DNA polymerase (exo-), Bca DNA polymerase (exo-), Klenow fragment of E. coli DNA polymerase, T5 polymerase, M-MuLV reverse transcriptase, HIV viral reverse transcriptase, Deep Vent® DNA polymerase and KOD DNA polymerase. The phi29 DNA polymerase can be wild type phi29 DNA polymerase (e.g., MagniPhi™ from Expedeon), or variant EquiPhi29M DNA polymerase (e.g., from Thermo Fisher Scientific), or chimeric QualiPhi™ DNA polymerase (e.g., from 4basebio)

In some embodiments, the on-support rolling circle amplification reaction generates immobilized concatemer template molecules with incorporated nucleotides having a scissile moiety that are distributed at random positions along individual immobilized concatemer template molecules. In some embodiments, the nucleotides having a scissile moiety are distributed at different positions in the different immobilized concatemer template molecules.

In some embodiments, the support comprises an excess of immobilized first and second surface primers compared to the number of immobilized concatemer template molecules.

In some embodiment, the immobilized concatemer template molecule can self-collapse into a compact nucleic acid nanoball. The nanoballs can be imaged and a FWHM measurement can be obtained to give the shape/size of the nanoballs.

In some embodiments, the immobilized first surface primers comprise single stranded oligonucleotides comprising DNA, RNA or a combination of DNA and RNA. The immobilized first surface primers can be immobilized to the support or immobilized to a coating on the support. The immobilized first surface primers can be embedded and attached (coupled) to the coating on the support. In some embodiments, the 5' end of the immobilized first surface primers are immobilized to a support or immobilized to a coating on the support. Alternatively, an interior portion or the 3' end of the immobilized first surface primers can be immobilized to a support or immobilized to a coating on the support. The support comprises a plurality of immobilized first surface primers having the same sequence. The immobilized first surface primers can be any length, for example 4-50 nucleotides, or 50-100 nucleotides, or 100-150 nucleotides, or longer lengths. In some embodiments, the 3' terminal end of the immobilized first surface primers comprise an extendible 3' OH moiety. In some embodiments, the 3' terminal end of the immobilized first surface primers comprise a 3' non-extendible moiety.

In some embodiments, the plurality of immobilized first surface primers comprise at least one phosphorothioate diester bond at their 5' ends which can render the first surface primers resistant to exonuclease degradation. In some embodiments, the plurality of immobilized first surface primers comprise 2-5 or more consecutive phosphorothioate diester bonds at their 5' ends. In some embodiments, the plurality of immobilized first surface primers comprise at least one ribonucleotide and/or at least one 2'-O-methyl or 2'-O-methoxyethyl (MOE) nucleotide which can render the first surface primers resistant to exonuclease degradation.

In some embodiments, the immobilized first surface primers comprise at least one locked nucleic acid (LNA) which comprises a methylene bridge bond between a 2' oxygen and 4' carbon of the pentose ring. Immobilized first surface primers that include at least one LNA can be resistant to nuclease digestions and can exhibit increased melting temperature when hybridized to the forward extension strand.

In some embodiments, the immobilized concatemer template molecules further comprise two or more copies of a universal binding sequence (or complementary sequence thereof) for an immobilized second surface primer having a sequence that differs from the first immobilized surface primer. The immobilized second surface primers of step (a) comprise single stranded oligonucleotides comprising DNA, RNA or a combination of DNA and RNA. The immobilized second surface primers can be immobilized to the support or immobilized to a coating on the support. The immobilized second surface primers can be embedded and attached (coupled) to the coating on the support. In some embodiments, the 5' end of the immobilized second surface primers are immobilized to a support or immobilized to a coating on the support. Alternatively, an interior portion or the 3' end of the immobilized second surface primers can be immobilized to a support or immobilized to a coating on the support. The support comprises a plurality of immobilized second surface primers having the same sequence. The immobilized second surface primers can be any length, for example 4-50 nucleotides, or 50-100 nucleotides, or 100-150 nucleotides, or longer lengths.

In some embodiments, the 3' terminal end of the immobilized second surface primers comprise an extendible 3' OH moiety. In some embodiments, the 3' terminal end of the immobilized second surface primers comprise a 3' non-extendible moiety. In some embodiments, the 3' terminal end of the immobilized second surface primers comprise a moiety that blocks primer extension (e.g., non-extendible terminal 3' end), such as for example a phosphate group, a dideoxycytidine group, an inverted dT, or an amino group. The immobilized second surface primers are not extendible in a primer extension reaction. The immobilized second surface primers lack a nucleotide having a scissile moiety.

In some embodiments, the plurality of immobilized second surface primers comprise at least one phosphorothioate diester bond at their 5' ends which can render the second surface primers resistant to exonuclease degradation. In some embodiments, the plurality of immobilized second surface primers comprise 2-5 or more consecutive phosphorothioate diester bonds at their 5' ends. In some embodiments, the plurality of immobilized second surface primers comprise at least one ribonucleotide and/or at least one 2'-O-methyl or 2'-O-methoxyethyl (MOE) nucleotide which can render the second surface primers resistant to exonuclease degradation.

In some embodiments, the support comprises about $10^2$-$10^{15}$ immobilized first surface primers per mm$^2$. In some embodiments, the support comprises about $10^2$-$10^{15}$ immobilized second surface primers per mm$^2$. In some embodiments, the support comprises about $10^2$-$10^{15}$ immobilized first surface primers and immobilized second surface primers per mm$^2$.

The immobilized surface primers (e.g., first and second surface primers) are in fluid communication with each other to permit flowing various solutions of linear or circular nucleic acid template molecules, soluble primers, enzymes, nucleotides, divalent cations, buffers, reagents, and the like, onto the support so that the plurality of immobilized surface primers (and the primer extension products generated from the immobilized surface primers) react with the solutions in a massively parallel manner.

In some embodiments, the pairwise sequencing method further comprises step (d): sequencing the plurality of immobilized concatemer template molecules with a plurality of soluble forward sequencing primers thereby generating a plurality of extended forward sequencing primer strands, wherein individual immobilized concatemer template molecules have two or more extended forward sequencing primer strands hybridized thereon.

The sequencing of step (d) comprises contacting the plurality of immobilized concatemer template molecules with a plurality of soluble forward sequencing primers under a condition suitable to hybridize at least one forward sequencing primer to at least one of the forward sequencing primer binding sites/sequences of the immobilized concatemer template molecules, and conducting forward sequencing reactions using one or more types of sequencing polymerases, a plurality of nucleotides and/or multivalent molecules, and the hybridized first forward sequencing primers. In some embodiments, the soluble forward sequencing primers comprise 3' OH extendible ends. In some embodiments, the soluble forward sequencing primers comprise a 3' blocking moiety which can be removed to generate a 3' OH extendible end. In some embodiments, the soluble forward sequencing primers lack a nucleotide having a scissile moiety. The forward sequencing reactions can generate a plurality of extended forward sequencing primer strands. In some embodiments, individual immobilized concatemer template molecules have multiple copies of the forward sequencing primer binding sites, wherein each forward sequencing primer binding site is capable of hybridizing to a first forward sequencing primer. Individual forward sequencing primer binding sites in a given immobilized concatemer template molecule can be hybridized to a forward sequencing primer and can undergo a sequencing reaction. Individual immobilized concatemer template molecules can undergo two or more sequence reactions, where each sequencing reaction is initiated from a forward sequencing primer that is hybridized to a forward sequencing primer binding site. In some embodiments, the sequencing reactions comprise a plurality of nucleotides (or analogs thereof) labeled with a detectable reporter moiety. In some embodiments, the sequencing reaction comprise a plurality of multivalent molecules having a plurality of nucleotide units attached to a core, where the multivalent molecules are labeled with a detectable reporter moiety. In some embodiments, the core is labeled with a detectable reporter moiety. In some embodiments, at least one linker and/or at least one nucleotide unit of a nucleotide arm is labeled with a detectable reporter moiety. In some embodiments, the detectable reporter moiety comprises a fluorophore. An exemplary nucleotide arm is shown in FIG. 108, and exemplary multivalent molecules are shown in FIGS. 104-107. The sequencing reactions that employ nucleotides and/or multivalent molecules are described in more detail below.

In some embodiments, the sequencing polymerases of step (d) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (d) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

In some embodiments, the sequencing of step (d) can be conducted in the presence or absence of a plurality of compaction oligonucleotides. The compaction oligonucleotides can retain the compact size and/or shape of the nanoballs (e.g., self-collapsed immobilized concatemer template molecules) during the forward sequencing reactions.

In some embodiments, the sequencing of step (d) can be conducted by contacting the plurality of immobilized concatemer template molecules with a plurality of forward sequencing primers in the presence of a hybridization solution comprising pH buffering agent, a sodium salt, and a chaotropic agent. Exemplary chaotropic agents include urea, guanidine hydrochloride and guanidine thiocyanate. In some embodiments, the hybridization solution comprises MES buffering agent, NaCl and guanidine hydrochloride.

In some embodiments, the sequencing of step (d) can be conducted by contacting the plurality of immobilized concatemer template molecules with a plurality of forward sequencing primers in the presence of a high efficiency hybridization buffer. In some embodiments, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, the pairwise sequencing method further comprises step (e): removing the extended forward sequencing primer strands and retaining the immobilized concatemer template molecules.

In some embodiments, in step (e), the plurality of extended forward sequencing primer strands can be removed using an enzyme or a chemical reagent. For example, the plurality of extended forward sequencing primer strands can be enzymatically degraded using a 5' to 3' double-stranded DNA exonuclease, including T7 exonuclease (e.g., from New England Biolabs, catalog #M0263S). In some embodiments, the plurality of extended forward sequencing primer strands can be removed with a temperature that favors nucleic acid denaturation.

In some embodiments, in step (e), a denaturation reagent can be used to remove the plurality of extended forward sequencing primer strands, wherein the denaturation reagent comprises any one or any combination of compounds such as formamide, acetonitrile, guanidinium chloride and/or a pH buffering agent (e.g., Tris-HCl, MES, HEPES, MOPS, or the like). Optionally, the denaturation reagent can further comprise PEG.

In some embodiments, in step (e), the plurality of extended forward sequencing primer strands can be removed using an elevated temperature (e.g., heat) with or without a nucleic acid denaturation reagent. The plurality of extended forward sequencing primer strands can be subjected to a temperature of about 45-50° C., or about 50-60° C., or about 60-70° C., or about 70-80° C., or about 80-90° C., or about 90-95° C., or higher temperature.

In some embodiments, in step (e), the plurality of extended forward sequencing primer strands can be removed using 100% formamide at a temperature of about 65° C. for about 3 minutes, and washing with a reagent comprising about 50 mM NaCl or equivalent ionic strength and having a pH of about 6.5-8.5.

In some embodiments, the pairwise sequencing method further comprises step (f): generating a first plurality of immobilized forward extension strands by hybridizing at least one portion of individual immobilized concatemer template molecules to a second surface primer and conducting a primer extension reaction from the second surface primers that are hybridized to a portion of the immobilized concatemer template molecule. The primer extension reaction generates a plurality of forward extension strands each having a sequence that is complementary to at least a portion of the immobilized concatemer template molecules. The primer extension reaction generates a plurality of forward extension strands that are covalently joined to an immobilized second surface primer.

In some embodiments, the primer extension reaction of step (f) comprises a plurality of nucleotides which lacks a nucleotide having a scissile moiety. For example, the plurality of nucleotides comprises dATP, dGTP, dCTP and dTTP. The primer extension reaction can be conducted at an isothermal temperature of about 50, 51, 52, 53, 54, 55, 56, 57, 58, 59, 60, 61, 62, 63, 64, 65, 66, 67 or 68° C.

The primer extension reaction of step (f) comprises a DNA polymerase capable of catalyzing a primer extension reaction using a uracil-containing template molecule (e.g., a uracil-tolerant polymerase). Exemplary polymerases include, but are not limited to, Q5U® Hot Start high-fidelity DNA polymerase (e.g., catalog #M0515S from New England Biolabs), Taq DNA polymerase, OneTaq® DNA polymerase (e.g., mixture of Taq and Deep Vent® DNA polymerases, catalog #M0480S from New England Biolabs), LongAmp® Taq DNA polymerase (e.g., catalog #M0323S from New England Biolabs), EpiMark® Hot Start Taq DNA polymerase (e.g., catalog #M0490S from New England Biolabs), Bst DNA polymerase (e.g., large fragment, catalog #M0275S from New England Biolabs), Bsu DNA polymerase (e.g., large fragment, catalog #M0330S from New England Biolabs), Phi29 DNA polymerase (e.g., catalog #M0269S from New England Biolabs), *E. coli* DNA polymerase (e.g., catalog #M0209S from New England Biolabs), Therminator™ DNA polymerase (e.g., catalog #M0261S from New England Biolabs), Vent® DNA polymerase and Deep Vent® DNA polymerase.

The primer extension reaction of step (f) comprises a polymerase having strand displacing activity. Examples of strand displacing polymerases include phi29 DNA polymerase, large fragment of Bst DNA polymerase, large fragment of Bsu DNA polymerase (exo-), Bca DNA polymerase (exo-), Klenow fragment of *E. coli* DNA polymerase, T5 polymerase, M-MuLV reverse transcriptase, HIV viral reverse transcriptase, Deep Vent® DNA polymerase and KOD DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio)

The immobilized first and second surface primers, the immobilized concatemer template molecules, and the immobilized forward extension strands, are in fluid communication with each other to permit flowing various solutions of buffers and reagents, and the like, onto the support. The immobilized first and second surface primers, the immobilized concatemer template molecules, and the immobilized forward extension strands can react with the solutions in a massively parallel manner.

In some embodiments, the pairwise sequencing method further comprises step (g): contacting the plurality of immobilized concatemer template molecules and the plurality of immobilized forward extension strands with a relaxing solution. The relaxing solution can be flowed onto the support to permit reaction with the immobilized concatemer template molecules and the immobilized forward extension strands in a massively parallel manner. The relaxing solution can be flowed onto the support at a temperature of about 20-25° C.

The relaxing solution comprises at least one nucleic acid relaxing agent that can disrupt hydrogen bonding between the immobilized concatemer template molecules and the second surface primers. Exemplary relaxing agents include nucleic acid denaturants, chaotropic compounds, amide compounds, aprotic compounds, primary alcohols and ethylene glycol derivatives. Chaotropic compounds comprise urea, guanidine hydrochloride or guanidine thiocyanate. Amide compounds comprise formamide, acetamide or NN-dimethylformamide (DMF). Aprotic compounds comprise acetonitrile, DMSO (dimethyl sulfoxide), 1,4-dioxane or tetrahydrofuran. Primary alcohols comprise 1-propanol, ethanol or methanol. Ethylene glycol derivatives comprise 1,3-propanediol, ethylene glycol, glycerol, 1,2-dimethyoxyethane or 2-methoxyethanol. Other relaxing agents include sodium iodide, potassium iodide and polyamines.

The relaxing solution of step (g) can further comprise an ionic, non-ionic or zwitterion detergent. Exemplary ionic detergents include SDS (sodium dodecyl sulfate). Exemplary non-ionic detergents include Triton X-100, Tween 20, Tween 80 or Nonidet P-40. Exemplary zwitterionic detergent include CHAPS (3-[(3-cholamidopropyl)dimethylammonio]-1-propanesulfonate) or N-Dodecyl-N,N-dimethyl-3-amonio-1-propanesulfate (DetX). In some embodiments, the detergent comprises LDS (lithium dodecyl sulfate), sodium taurodeoxycholate, sodium taurocholate, sodium glycocholate, sodium deoxycholate or sodium cholate.

The relaxing solution of step (g) can further comprise a pH buffering compound (e g., zwitterionic buffering compound such as or 4-(2-hydroxyethyl)-1-piperazineethanesulfonic acid (HEPES)).

In some embodiments, the relaxing solution of step (g) comprises any one or a combination of two or more of a group selected from urea, guanidine hydrochloride, guanidine thiocyanate, formamide, acetamide, NN-dimethylformamide (DMF), acetonitrile, DMSO (dimethyl sulfoxide), 1,4-dioxane, tetrahydrofuran, 1-propanol, ethanol, methanol, 1,3-propanediol, ethylene glycol, glycerol, 1,2-dimethyoxyethane, 2-methoxyethanol, sodium iodide, potassium iodide and/or polyamines.

In some embodiments, the relaxing solution of step (g) comprises formamide and SSC. In some embodiments, the relaxing solution comprises acetonitrile, formamide and SSC. In some embodiments, the relaxing solution comprises acetonitrile, formamide and MES (2-(4-morpholino)-ethane sulfonic acid). In some embodiments, the relaxing solution comprises acetonitrile, formamide, guanidine hydrochloride and HEPES (4-(2-hydroxyethyl)-1-piperazineethanesulfonic acid) and a detergent (e.g., a zwitterion detergent such as Tween-20 or Tween-80). In some embodiments, the relaxing solution comprises acetonitrile, formamide, urea and HEPES. In some embodiments, the concentration of the SSC in the relaxing solution can be 1×, 2×, 3× or 4×.

In some embodiments, the pairwise sequencing method further comprises step (h): dissociating the at least one portion of the immobilized concatemer template molecules from the immobilized second surface primers and retaining the immobilized forward extension strands, and re-hybridizing at least one portion of the immobilized concatemer template molecules to one of the immobilized second surface primers that are not covalently joined to a forward extension strand. In some embodiments, the nucleic acid dissociating and re-hybridizing are conducted in the presence of the relaxing solution, and comprises a temperature ramp-up, a temperature plateau, and a temperature ramp-down (e.g., FIG. 117). The temperature ramp-up can start at about 20-25° C. and increase to about 55-70° C. The temperature plateau can be held at about 50-70° C. The temperature ramp-down can start at about 50-70° C. and decrease to about 20-25° C. The relaxing solution can be removed from the support by conducting at least one washing with a wash solution. The wash solution can include SSC (e.g., at any concentration of about 1-5×) and a detergent (e.g., Tween-20). A skilled artisan will recognize that the temperature ramp-up, temperature plateau, and temperature ramp-down conditions can be modified.

In some embodiments, the forward extension strands that are duplexed with the immobilized concatemer template molecules (e.g., generated in step (f)) can be denatured, and re-hybridized with a first surface primer, in the presence of the relaxing solution, the temperature ramp-up, temperature plateau, and temperature ramp-down.

In some embodiments, the pairwise sequencing method further comprises step (i): contacting the re-hybridized immobilized concatemer template molecules with an amplification solution and conducting a primer extension reaction from the second surface primers that are re-hybridized to a portion of the immobilized concatemer template molecules to generate a plurality of newly synthesized forward extension strands having a sequence that is complementary to at least a portion of the immobilized concatemer template molecules and are covalently joined to an immobilized second surface primer. The amplifying of step (i) is conducted after the temperature ramp-up, temperature plateau, temperature ramp-down, and washing of step (h) which is described above.

In some embodiments, the forward extension strands that are re-hybridized with a first surface primer (e.g., generated in step (h)), can be contacted with the amplification solution and subjected to a primer extension reaction to generate a plurality of newly synthesized concatemer template molecules when the plurality of immobilized first surface primers comprise a 3' extendible end. Alternatively, when the immobilized first surface primers comprise a 3' non-extendible end, then the amplification reaction will not generate newly synthesized concatemer template molecules.

In some embodiments, the amplification solution of step (i) comprises a plurality of nucleotides which lacks a nucleotide having a scissile moiety. For example, the plurality of nucleotides comprises dATP, dGTP, dCTP and dTTP. The amplification reaction can be conducted at an isothermal temperature of about 50, 51, 52, 53, 54, 55, 56, 57, 58, 59, 60, 61, 62, 63, 64, 65, 66, 67 or 68° C.

The amplification solution of step (i) comprises a DNA polymerase capable of catalyzing a primer extension reaction using a uracil-containing template molecule (e.g., a uracil-tolerant polymerase). Exemplary polymerases include, but are not limited to, Q5U® Hot Start high-fidelity DNA polymerase (e.g., catalog #M0515S from New England Biolabs), Taq DNA polymerase, OneTaq® DNA polymerase (e.g., mixture of Taq and Deep Vent® DNA polymerases, catalog #M0480S from New England Biolabs), LongAmp® Taq DNA polymerase (e.g., catalog #M0323S from New England Biolabs), EpiMark® Hot Start Taq DNA polymerase (e.g., catalog #M0490S from New England Biolabs), Bst DNA polymerase (e.g., large fragment, catalog #M0275S from New England Biolabs), Bsu DNA polymerase (e.g., large fragment, catalog #M0330S from New England Biolabs), Phi29 DNA polymerase (e.g., catalog #M0269S from New England Biolabs), E. coli DNA polymerase (e.g., catalog #M0209S from New England Biolabs), Therminator™ DNA polymerase (e.g., catalog #M0261S from New England Biolabs), Vent® DNA polymerase and Deep Vent® DNA polymerase.

The amplification solution of step (i) comprises a polymerase having strand displacing activity. Examples of strand displacing polymerases include phi29 DNA polymerase, large fragment of Bst DNA polymerase, large fragment of Bsu DNA polymerase (exo-), Bca DNA polymerase (exo-), Klenow fragment of E. coli DNA polymerase, T5 polymerase, M-MuLV reverse transcriptase, HIV viral reverse transcriptase, Deep Vent® DNA polymerase and KOD DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio).

In some embodiments, the pairwise sequencing method further comprises step (j): conducting a flexing amplification cycle by repeating steps (g)-(i) at least once. Steps (g)-(i) can be repeated once, twice, thrice, four times, five times, six times, or up to ten times. Each cycle can generate additional newly synthesized forward extension strands that are covalently joined to a second surface primer. Each cycle can generate additional newly synthesized concatemer template molecules that are covalently joined to a first surface primer. After conducting the desired number of flexing amplification cycles, step (k) can be conducted as described directly below.

In some embodiments, the pairwise sequencing method further comprises step (k): removing the immobilized concatemer template molecules by generating abasic sites in the immobilized single stranded concatemer template molecules and in the immobilized first surface primers at the nucleotide(s) having the scissile moiety, and generating gaps at the abasic sites thereby generating a plurality of gap-containing nucleic acid molecules while retaining the plurality of immobilized forward extension strands and retaining the plurality of immobilized second surface primers. The gap-containing nucleic acid molecules include the immobilized concatemer template strands and the immobilized first surface primers.

The abasic sites are generated on the concatemer template strands and the immobilized first surface primers that contain nucleotides having scissile moieties. In some embodiments, the scissile moieties in the concatemer template molecules comprises uridine, 8-oxo-7,8-dihydroguanine (e.g., 8oxoG) or deoxyinosine. The abasic sites can be removed to generate a plurality of concatemer template molecules and first surface primers having gaps while retaining the plurality of forward extension strands. The abasic sites can be generated by contacting the immobilized concatemer template molecules and the first surface primers with an enzyme that removes the nucleo-base at the nucleotide having the scissile moiety. The uracil in the concatemer template strands and the first surface primers can be converted to an abasic site using uracil DNA glycosylase (UDG). The 8oxoG in the concatemer template strands and the first surface primers can be converted to an abasic site using FPG glycosylase. The deoxyinosine in the concatemer template strands and the first surface primers can be converted to an abasic site using AlkA glycosylase.

In some embodiments, in step (k), the gaps can be generated by contacting the abasic sites with an enzyme or a mixture of enzymes having lyase activity that breaks the phosphodiester backbone at the 5' and 3' sides of the abasic site to release the base-free deoxyribose and generate a gap. The abasic sites can be removed using AP lyase, Endo IV endonuclease, FPG glycosylase/AP lyase, Endo VIII glycosylase/AP lyase. In some embodiments, generating the abasic sites and removal of the abasic sites to generate gaps can be achieved using a mixture of uracil DNA glycosylase and DNA glycosylase-lyase endonuclease VIII, for example USER™ (Uracil-Specific Excision Reagent Enzyme from New England Biolabs) or thermolabile USER™ (also from New England Biolabs).

In some embodiments, in step (k), the plurality of gap-containing template molecules can be removed using an enzyme, chemical and/or heat. After the gap-removal procedure, the plurality of immobilized forward extension strands that are covalently joined to the second surface primers are retained.

For example, the plurality of gap-containing template molecules can be enzymatically degraded using a 5' to 3' double-stranded DNA exonuclease, including T7 exonuclease (e.g., from New England Biolabs, catalog #M0263S).

In some embodiments, the plurality of gap-containing template molecules can be removed using a chemical reagent that favors nucleic acid denaturation. The denaturation reagent can include any one or any combination of compounds such as formamide, acetonitrile, guanidinium chloride and/or a buffering agent (e.g., Tris-HCl, MES, HEPES, or the like).

In some embodiments, the plurality of gap-containing template molecules can be removed using an elevated temperature (e.g., heat) with or without a nucleic acid denaturation reagent. The gap-containing template molecules can be subjected to a temperature of about 45-50° C., or about 50-60° C., or about 60-70° C., or about 70-80° C., or about 80-90° C., or about 90-95° C., or higher temperature.

In some embodiments, the plurality of gap-containing template molecules can be removed using 100% formamide at a temperature of about 65° C. for about 3 minutes, and washing with a reagent comprising about 50 mM NaCl or equivalent ionic strength and having a pH of about 6.5-8.5.

In some embodiments, the pairwise sequencing method further comprises step (l): sequencing the plurality of retained forward extension strands with a plurality of soluble reverse sequencing primers thereby generating a plurality of extended reverse sequencing primer strands. In some embodiments, the sequencing of step (l) comprises contacting the plurality of retained forward extension strands with a plurality of soluble reverse sequencing primers under a condition suitable to hybridize the reverse sequencing primers to the reverse sequencing primer binding site of the retained forward extension strands, and by conducting sequencing reactions using the hybridized reverse sequencing primers wherein the forward sequencing reactions generates a plurality of extended reverse sequencing primer strands.

Individual retained forward extension strands can include two or more copies of the reverse sequencing primer strands hybridized thereon. The reverse sequencing reaction can generate a plurality of extended reverse sequencing primer strands hybridized to the same retained forward extension strand.

In some embodiments, the sequencing of step (1) can be conducted in the presence or absence of a plurality of compaction oligonucleotides. The compaction oligonucleotides can retain the compact size and/or shape of the nanoballs (e.g., self-collapsed immobilized concatemer template molecules) during the reverse sequencing reactions.

In some embodiments, in step (1), the condition suitable to hybridize the reverse sequencing primers to the reverse sequencing primer binding sequences of the retained forward extension strands comprises contacting the plurality of soluble reverse sequencing primers and the retained forward extension strands with a hybridization solution comprising pH buffering agent, a sodium salt, and a chaotropic agent. Exemplary chaotropic agents include urea, guanidine hydrochloride and guanidine thiocyanate. In some embodiments, the hybridization solution comprises MES buffering agent, NaCl and guanidine hydrochloride.

In some embodiments, in step (1), the condition suitable to hybridize the reverse sequencing primers to the reverse sequencing primer binding sequences of the retained forward extension strands comprises contacting the plurality of soluble reverse sequencing primers and the retained forward extension strands with a high efficiency hybridization buffer. In some embodiments, the high efficiency hybridization buffer comprises: (i) a first polar aprotic solvent having a dielectric constant that is no greater than 40 and having a polarity index of 4-9; (ii) a second polar aprotic solvent having a dielectric constant that is no greater than 115 and is present in the hybridization buffer formulation in an amount effective to denature double-stranded nucleic acids; (iii) a pH buffer system that maintains the pH of the hybridization buffer formulation in a range of about 4-8; and (iv) a crowding agent in an amount sufficient to enhance or facilitate molecular crowding. In some embodiments, the high efficiency hybridization buffer comprises: (i) the first polar aprotic solvent comprises acetonitrile at 25-50% by volume of the hybridization buffer; (ii) the second polar aprotic solvent comprises formamide at 5-10% by volume of the hybridization buffer; (iii) the pH buffer system comprises 2-(N-morpholino)ethanesulfonic acid (MES) at a pH of 5-6.5; and (iv) the crowding agent comprises polyethylene glycol (PEG) at 5-35% by volume of the hybridization buffer. In some embodiments, the high efficiency hybridization buffer further comprises betaine.

In some embodiments, the reverse sequencing reactions of step (1) comprises contacting the plurality of soluble reverse sequencing primers with the reverse sequencing primer binding sequences of the retained forward extension strands, one or more types of sequencing polymerases, and a plurality of nucleotides or a plurality of multivalent molecules. In some embodiments, the soluble reverse sequencing primers comprise 3' OH extendible ends. In some embodiments, the soluble reverse sequencing primers comprise a 3' blocking moiety which can be removed to generate a 3' OH extendible end. In some embodiments, the soluble reverse sequencing primers lack a nucleotide having a scissile moiety. The sequencing reactions that employ nucleotides and/or multivalent molecules are described in more detail below. The reverse sequencing reactions can generate a plurality of extended reverse sequencing primer strands. In some embodiments, individual retained forward extension strands have multiple copies of the reverse sequencing primer binding sequences/sites, wherein each reverse sequencing primer binding site is capable of hybridizing to a reverse sequencing primer. Individual reverse sequencing primer binding sites in a given retained forward extension strand can be hybridized to a reverse sequencing primer and can undergo a sequencing reaction. Thus, an individual retained forward extension strand can undergo two or more sequence reactions, where each sequencing reaction is initiated from a reverse sequencing primer that is hybridized to a reverse sequencing primer binding site. In some embodiments, the sequencing reactions comprise a plurality of nucleotides (or analogs thereof) labeled with a detectable reporter moiety. In some embodiments, the sequencing reaction comprise a plurality of multivalent molecules having nucleotide units, where the multivalent molecules are labeled with a detectable reporter moiety. In some embodiments, the detectable reporter moiety comprises a fluorophore. The sequencing reactions that employ nucleotides and/or multivalent molecules are described in more detail below.

In some embodiments, the sequencing polymerases of step (1) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 1, 2, 1316, 2215, 2367, 2393, 2408, 2436 or 2455.

In some embodiments, the sequencing polymerases of step (1) comprise engineered polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

In some embodiments, at least one washing step can be conducted after any of steps (a)-(l). The washing step can be conducted with a wash solution comprising a pH buffering agent, a metal chelating agent, a salt, and a detergent.

In some embodiments, the pH buffering compound in the wash solution comprises any one or any combination of two or more of Tris, Tris-HCl, Tricine, Bicine, Bis-Tris propane, HEPES, MES, MOPS, MOPSO, BES, TES, CAPS, TAPS, TAPSO, ACES, PIPES, ethanolamine (a.k.a 2-amino methanol, MEA), a citrate compound, a citrate mixture, NaOH and/or KOH. In some embodiments, the pH buffering agent can be present in the wash solution at a concentration of about 1-100 mM, or about 10-50 mM, or about 10-25 mM. In some embodiments, the pH of the pH buffering agent which is present in any of the reagents described here in can be adjusted to a pH of about 4-9, or a pH of about 5-9, or a pH of about 5-8.

In some embodiments, the metal chelating agent in the wash solution comprises EDTA (ethylenediaminetetraacetic acid), EGTA (ethylene glycol tetraacetic acid), HEDTA (hydroxyethylethylenediaminetriacetic acid), DPTA (diethylene triamine pentaacetic acid), NTA (N,N-bis(carboxymethyl)glycine), citrate anhydrous, sodium citrate, calcium citrate, ammonium citrate, ammonium bicitrate, citric acid, potassium citrate, or magnesium citrate. In some embodiments, the wash solution comprises a chelating agent at a concentration of about 0.01-50 mM, or about 0.1-20 mM, or about 0.2-10 mM.

In some embodiments, the salt in the wash solution comprises NaCl, KCl, $NH_2SO_4$ or potassium glutamate. In some embodiments, the detergent comprises an ionic detergent such as SDS (sodium dodecyl sulfate). The wash solution can include a monovalent salt at a concentration of about 25-500 mM, or about 50-250 mM, or about 100-200 mM.

In some embodiments, the detergent in the wash solution comprises a non-ionic detergent such as Triton X-100, Tween 20, Tween 80 or Nonidet P-40. In some embodiments, the detergent comprises a zwitterionic detergent such as CHAPS (3-[(3-cholamidopropyl)dimethylammonio]-1-propanesulfonate) or N-Dodecyl-N,N-dimethyl-3-amonio-1-propanesulfate (DetX). In some embodiments, the detergent comprises LDS (lithium dodecyl sulfate), sodium taurodeoxycholate, sodium taurocholate, sodium glycocholate, sodium deoxycholate or sodium cholate. In some embodiments, the detergent is included in the wash solution at a concentration of about 0.01-0.05%, or about 0.05-0.1%, or about 0.1-0.15%, or about 0.15-0.2%, or about 0.2-0.25%.

The wash solution can include SSC (e.g., at any concentration of about 1-5×) and a detergent (e.g., Tween-20).

Supports and Low Non-Specific Coatings

The present disclosure provides pairwise sequencing compositions and methods which employ a support comprising a plurality of oligonucleotide surface primers immobilized thereon. In some embodiments, the support is passivated with a low non-specific binding coating. The surface coatings described herein exhibit very low non-specific binding to reagents typically used for nucleic acid capture, amplification and sequencing workflows, such as dyes, nucleotides, enzymes, and nucleic acid primers. The surface coatings exhibit low background fluorescence signals or high contrast-to-noise (CNR) ratios compared to conventional surface coatings.

The low non-specific binding coating comprises one layer or multiple layers (FIG. 115). In some embodiments, the plurality of surface primers are immobilized to the low non-specific binding coating. In some embodiments, at least one surface primer is embedded within the low non-specific binding coating. The low non-specific binding coating enables improved nucleic acid hybridization and amplification performance. In general, the supports comprise a substrate (or support structure), one or more layers of a covalently or non-covalently attached low-binding, chemical modification layers, e.g., silane layers, polymer films, and one or more covalently or non-covalently attached surface primers that can be used for tethering single-stranded nucleic acid library molecules to the support. In some embodiments, the formulation of the coating, e.g., the chemical composition of one or more layers, the coupling chemistry used to cross-link the one or more layers to the support and/or to each other, and the total number of layers, may be varied such that non-specific binding of proteins, nucleic acid molecules, and other hybridization and amplification reaction components to the coating is minimized or reduced relative to a comparable monolayer. The formulation of the coating described herein may be varied such that non-specific hybridization on the coating is minimized or reduced relative to a comparable monolayer. The formulation of the coating may be varied such that non-specific amplification on the coating is minimized or reduced relative to a comparable monolayer. The formulation of the coating may be varied such that specific amplification rates and/or yields on the coating are maximized. Amplification levels suitable for detection are achieved in no more than 2, 3, 4, 5, 6, 7, 8, 9, 10, 15, 20, 25, 30, or more than 30 amplification cycles in some cases disclosed herein.

The support structure that comprises the one or more chemically-modified layers, e.g., layers of a low non-specific binding polymer, may be independent or integrated into another structure or assembly. For example, in some embodiments, the support structure may comprise one or more surfaces within an integrated or assembled microfluidic flow cell. The support structure may comprise one or more surfaces within a microplate format, e.g., the bottom surface of the wells in a microplate. In some embodiments, the support structure comprises the interior surface (such as the lumen surface) of a capillary. In some embodiments, the support structure comprises the interior surface (such as the lumen surface) of a capillary etched into a planar chip.

The attachment chemistry used to graft a first chemically-modified layer to the surface of the support will generally be dependent on both the material from which the surface is fabricated and the chemical nature of the layer. In some embodiments, the first layer may be covalently attached to the surface. In some embodiments, the first layer may be non-covalently attached, e.g., adsorbed to the support through non-covalent interactions such as electrostatic interactions, hydrogen bonding, or van der Waals interactions between the support and the molecular components of the first layer. In either case, the support may be treated prior to attachment or deposition of the first layer. Any of a variety of surface preparation techniques known to those of skill in the art may be used to clean or treat the surface. For example, glass or silicon surfaces may be acid-washed using a Piranha solution (a mixture of sulfuric acid ($H_2SO_4$) and hydrogen peroxide ($H_2O_2$)), base treatment in KOH and NaOH, and/or cleaned using an oxygen plasma treatment method.

Silane chemistries constitute non-limiting approaches for covalently modifying the silanol groups on glass or silicon surfaces to attach more reactive functional groups (e.g., amines or carboxyl groups), which may then be used in coupling linker molecules (e.g., linear hydrocarbon molecules of various lengths, such as C6, C12, C18 hydrocarbons, or linear polyethylene glycol (PEG) molecules) or layer molecules (e.g., branched PEG molecules or other polymers) to the surface. Examples of suitable silanes that may be used in creating any of the disclosed low binding coatings include, but are not limited to, (3-Aminopropyl) trimethoxysilane (APTMS), (3-Aminopropyl) triethoxysilane (APTES), any of a variety of PEG-silanes (e.g., comprising molecular weights of 1K, 2K, 5K, 10K, 20K, etc.), amino-PEG silane (i.e., comprising a free amino functional group), maleimide-PEG silane, biotin-PEG silane, and the like.

Any of a variety of molecules known to those of skill in the art including, but not limited to, amino acids, peptides, nucleotides, oligonucleotides, other monomers or polymers, or combinations thereof may be used in creating the one or more chemically-modified layers on the support, where the choice of components used may be varied to alter one or more properties of the layers, e.g., the surface density of functional groups and/or tethered oligonucleotide primers, the hydrophilicity/hydrophobicity of the layers, or the three three-dimensional nature (i.e., "thickness") of the layer. Examples of polymers that may be used to create one or more layers of low non-specific binding material in any of the disclosed coatings include, but are not limited to, polyethylene glycol (PEG) of various molecular weights and branching structures, streptavidin, polyacrylamide, polyester, dextran, poly-lysine, and poly-lysine copolymers, or any combination thereof. Examples of conjugation chemistries that may be used to graft one or more layers of material (e.g.

polymer layers) to the surface and/or to cross-link the layers to each other include, but are not limited to, biotin-streptavidin interactions (or variations thereof), his tag-Ni/NTA conjugation chemistries, methoxy ether conjugation chemistries, carboxylate conjugation chemistries, amine conjugation chemistries, NHS esters, maleimides, thiol, epoxy, azide, hydrazide, alkyne, isocyanate, and silane.

The low non-specific binding surface coating may be applied uniformly across the support. Alternatively, the surface coating may be patterned, such that the chemical modification layers are confined to one or more discrete regions of the support. For example, the coating may be patterned using photolithographic techniques to create an ordered array or random pattern of chemically-modified regions on the support. Alternately or in combination, the coating may be patterned using, e.g., contact printing and/or ink-jet printing techniques. In some embodiments, an ordered array or random pattern of chemically-modified regions may comprise at least 1, 5, 10, 20, 30, 40, 50, 60, 70, 80, 90, 100, 200, 300, 400, 500, 600, 700, 800, 900, 1000, 2000, 3000, 4000, 5000, 6000, 7000, 8000, 9000, or 10,000 or more discrete regions.

In some embodiments, the low nonspecific binding coatings comprise hydrophilic polymers that are non-specifically adsorbed or covalently grafted to the support. Typically, passivation is performed utilizing poly(ethylene glycol) (PEG, also known as polyethylene oxide (PEO) or polyoxyethylene) or other hydrophilic polymers with different molecular weights and end groups that are linked to a support using, for example, silane chemistry. The end groups distal from the surface can include, but are not limited to, biotin, methoxy ether, carboxylate, amine, NHS ester, maleimide, and bis-silane. In some embodiments, two or more layers of a hydrophilic polymer, e.g., a linear polymer, branched polymer, or multi-branched polymer, may be deposited on the surface. In some embodiments, two or more layers may be covalently coupled to each other or internally cross-linked to improve the stability of the resulting coating. In some embodiments, surface primers with different nucleotide sequences and/or base modifications (or other biomolecules, e.g., enzymes or antibodies) may be tethered to the resulting layer at various surface densities. In some embodiments, for example, both surface functional group density and surface primer concentration may be varied to attain a desired surface primer density range. Additionally, surface primer density can be controlled by diluting the surface primers with other molecules that carry the same functional group. For example, amine-labeled surface primers can be diluted with amine-labeled polyethylene glycol in a reaction with an NHS-ester coated surface to reduce the final primer density. Surface primers with different lengths of linker between the hybridization region and the surface attachment functional group can also be applied to control surface density. Example of suitable linkers include poly-T and poly-A strands at the 5' end of the primer (e.g., 0 to 20 bases), PEG linkers (e.g., 3 to 20 monomer units), and carbon-chain (e.g., C6, C12, C18, etc.). To measure the primer density, fluorescently-labeled primers may be tethered to the surface and a fluorescence reading then compared with that for a dye solution of known concentration.

In some embodiments, the low nonspecific binding coatings comprise a functionalized polymer coating layer covalently bound at least to a portion of the support via a chemical group on the support, a primer grafted to the functionalized polymer coating, and a water-soluble protective coating on the primer and the functionalized polymer coating. In some embodiments, the functionalized polymer coating comprises a poly(N-(5-azidoacetamidylpentyl)acrylamide-co-acrylamide (PAZAM).

In order to scale primer surface density and add additional dimensionality to hydrophilic or amphoteric coatings, supports comprising multi-layer coatings of PEG and other hydrophilic polymers have been developed. By using hydrophilic and amphoteric surface layering approaches that include, but are not limited to, the polymer/co-polymer materials described below, it is possible to increase primer loading density on the support significantly. Traditional PEG coating approaches use monolayer primer deposition, which have been generally reported for single molecule applications, but do not yield high copy numbers for nucleic acid amplification applications. As described herein "layering" can be accomplished using traditional crosslinking approaches with any compatible polymer or monomer subunits such that a surface comprising two or more highly crosslinked layers can be built sequentially. Examples of suitable polymers include, but are not limited to, streptavidin, poly acrylamide, polyester, dextran, poly-lysine, and copolymers of poly-lysine and PEG. In some embodiments, the different layers may be attached to each other through any of a variety of conjugation reactions including, but not limited to, biotin-streptavidin binding, azide-alkyne click reaction, amine-NHS ester reaction, thiol-maleimide reaction, and ionic interactions between positively charged polymer and negatively charged polymer. In some embodiments, high primer density materials may be constructed in solution and subsequently layered onto the surface in multiple steps.

Examples of materials from which the support structure may be fabricated include, but are not limited to, glass, fused-silica, silicon, a polymer (e.g., polystyrene (PS), macroporous polystyrene (MPPS), polymethylmethacrylate (PMMA), polycarbonate (PC), polypropylene (PP), polyethylene (PE), high density polyethylene (HDPE), cyclic olefin polymers (COP), cyclic olefin copolymers (COC), polyethylene terephthalate (PET)), or any combination thereof. Various compositions of both glass and plastic support structures are contemplated.

The support structure may be rendered in any of a variety of geometries and dimensions known to those of skill in the art, and may comprise any of a variety of materials known to those of skill in the art. For example, the support structure may be locally planar (e.g., comprising a microscope slide or the surface of a microscope slide). Globally, the support structure may be cylindrical (e.g., comprising a capillary or the interior surface of a capillary), spherical (e.g., comprising the outer surface of a non-porous bead), or irregular (e.g., comprising the outer surface of an irregularly-shaped, non-porous bead or particle). In some embodiments, the surface of the support structure used for nucleic acid hybridization and amplification may be a solid, non-porous surface. In some embodiments, the surface of the support structure used for nucleic acid hybridization and amplification may be porous, such that the coatings described herein penetrate the porous surface, and nucleic acid hybridization and amplification reactions performed thereon may occur within the pores.

The support structure that comprises the one or more chemically-modified layers, e.g., layers of a low non-specific binding polymer, may be independent or integrated into another structure or assembly. For example, the support structure may comprise one or more surfaces within an integrated or assembled microfluidic flow cell. The support structure may comprise one or more surfaces within a microplate format, e.g., the bottom surface of the wells in a microplate. In some embodiments, the support structure comprises the interior surface (such as the lumen surface) of a capillary. In some embodiments the support structure comprises the interior surface (such as the lumen surface) of a capillary etched into a planar chip.

As noted, the low non-specific binding supports of the present disclosure exhibit reduced non-specific binding of proteins, nucleic acids, and other components of the hybridization and/or amplification formulation used for solid-phase nucleic acid amplification. The degree of non-specific binding exhibited by a given support surface may be assessed either qualitatively or quantitatively. For example, exposure of the surface to fluorescent dyes (e.g., cyanins such as Cy3, or Cy5, etc., fluoresceins, coumarins, rhodamines, etc. or other dyes disclosed herein), fluorescently-labeled nucleotides, fluorescently-labeled oligonucleotides, and/or fluorescently-labeled proteins (e.g. polymerases) under a standardized set of conditions, followed by a specified rinse protocol and fluorescence imaging may be used as a qualitative tool for comparison of non-specific binding on supports comprising different surface formulations. In some embodiments, exposure of the surface to fluorescent dyes, fluorescently-labeled nucleotides, fluorescently-labeled oligonucleotides, and/or fluorescently-labeled proteins (e.g. polymerases) under a standardized set of conditions, followed by a specified rinse protocol and fluorescence imaging may be used as a quantitative tool for comparison of non-specific binding on supports comprising different surface formulations-provided that care has been taken to ensure that the fluorescence imaging is performed under conditions where fluorescence signal is linearly related (or related in a predictable manner) to the number of fluorophores on the support surface (e.g., under conditions where signal saturation and/or self-quenching of the fluorophore is not an issue) and suitable calibration standards are used. In some embodiments, other techniques known to those of skill in the art, for example, radioisotope labeling and counting methods may be used for quantitative assessment of the degree to which non-specific binding is exhibited by the different support surface formulations of the present disclosure.

Some surfaces disclosed herein exhibit a ratio of specific to nonspecific binding of a fluorophore such as Cy3 of at least 2, 3, 4, 5, 6, 7, 8, 9, 10, 11, 12, 13, 14, 15, 16, 17, 18, 19, 20, 25, 30, 35, 40, 50, 75, 100, or greater than 100, or any intermediate value spanned by the range herein. Some surfaces disclosed herein exhibit a ratio of specific to nonspecific fluorescence of a fluorophore such as Cy3 of at least 2, 3, 4, 5, 6, 7, 8, 9, 10, 11, 12, 13, 14, 15, 16, 17, 18, 19, 20, 25, 30, 35, 40, 50, 75, 100, or greater than 100, or any intermediate value spanned by the range herein.

The degree of non-specific binding exhibited by the disclosed low-binding supports may be assessed using a standardized protocol for contacting the surface with a labeled protein (e.g., bovine serum albumin (BSA), streptavidin, a DNA polymerase, a reverse transcriptase, a helicase, a single-stranded binding protein (SSB), etc., or any combination thereof), a labeled nucleotide, a labeled oligonucleotide, etc., under a standardized set of incubation and rinse conditions, followed be detection of the amount of label remaining on the surface and comparison of the signal resulting therefrom to an appropriate calibration standard. In some embodiments, the label may comprise a fluorescent label. In some embodiments, the label may comprise a radioisotope. In some embodiments, the label may comprise any other detectable label known to one of skill in the art. In some embodiments, the degree of non-specific binding exhibited by a given support surface formulation may thus be assessed in terms of the number of non-specifically bound protein molecules (or nucleic acid molecules or other molecules) per unit area. In some embodiments, the low-binding supports of the present disclosure may exhibit non-specific protein binding (or non-specific binding of other specified molecules, (e.g., cyanins such as Cy3, or Cy5, etc., fluoresceins, coumarins, rhodamines, etc. or other dyes disclosed herein)) of less than 0.001 molecule per $\mu m^2$, less than 0.01 molecule per $\mu m^2$, less than 0.1 molecule per $\mu m^2$, less than 0.25 molecule per $\mu m^2$, less than 0.5 molecule per $\mu m^2$, less than 1 molecule per $\mu m^2$, less than 10 molecules per $\mu m^2$, less than 100 molecules per $\mu m^2$, or less than 1,000 molecules per $\mu m^2$. Those of skill in the art will realize that a given support surface of the present disclosure may exhibit non-specific binding falling anywhere within this range, for example, of less than 86 molecules per $\mu m^2$. For example, some modified surfaces disclosed herein exhibit nonspecific protein binding of less than 0.5 molecule/$\mu m^2$ following contact with a 1 $\mu M$ solution of Cy3 labeled streptavidin (GE Amersham) in phosphate buffered saline (PBS) buffer for 15 minutes, followed by 3 rinses with deionized water. Some modified surfaces disclosed herein exhibit nonspecific binding of Cy3 dye molecules of less than 0.25 molecules per $\mu m^2$. In independent nonspecific binding assays, 1 $\mu M$ labeled Cy3 SA (ThermoFisher), 1 $\mu M$ Cy5 SA dye (ThermoFisher), 10 $\mu M$ Aminoallyl-dUTP-ATTO-647N (Jena Biosciences), 10 $\mu M$ Aminoallyl-dUTP-ATTO-Rho1 1 (Jena Biosciences), 10 $\mu M$ Aminoallyl-dUTP-ATTO-Rho1 1 (Jena Biosciences), 10 $\mu M$ 7-Propargylamino-7-deaza-dGTP-Cy5 (Jena Biosciences, and 10 $\mu M$ 7-Propargylamino-7-deaza-dGTP-Cy3 (Jena Biosciences) were incubated on the low binding coated supports at 37° C. for 15 minutes in a 384 well plate format. Each well was rinsed 2-3× with 50 ul deionized RNase/DNase Free water and 2-3× with 25 mM ACES buffer pH 7.4. The 384 well plates were imaged on a GE Typhoon instrument using the Cy3, AF555, or Cy5 filter sets (according to dye test performed) as specified by the manufacturer at a PMT gain setting of 800 and resolution of 50-100 $\mu m$. For higher resolution imaging, images were collected on an Olympus 1×83 microscope (e.g., inverted fluorescence microscope) (Olympus Corp., Center Valley, Pa.) with a total internal reflectance fluorescence (TIRF) objective (100×, 1.5 NA, Olympus), a CCD camera (e.g., an Olympus EM-CCD monochrome camera, Olympus XM-10 monochrome camera, or an Olympus DP80 color and monochrome camera), an illumination source (e.g., an Olympus 100 W Hg lamp, an Olympus 75 W Xe lamp, or an Olympus U-HGLGPS fluorescence light source), and excitation wavelengths of 532 nm or 635 nm. Dichroic mirrors were purchased from Semrock (IDEX Health & Science, LLC, Rochester, N.Y.), e.g., 405, 488, 532, or 633 nm dichroic reflectors/beamsplitters, and band pass filters were chosen as 532 LP or 645 LP concordant with the appropriate excitation wavelength. Some modified surfaces disclosed herein exhibit nonspecific binding of dye molecules of less than 0.25 molecules per $\mu m^2$. In some embodiments, the coated support was immersed in a buffer (e.g., 25 mM ACES, pH 7.4) while the image was acquired.

In some embodiments, the surfaces disclosed herein exhibit a ratio of specific to nonspecific binding of a fluorophore such as Cy3 of at least 2, 3, 4, 5, 6, 7, 8, 9, 10, 11, 12, 13, 14, 15, 16, 17, 18, 19, 20, 25, 30, 35, 40, 50, 75, 100, or greater than 100, or any intermediate value spanned by the range herein. In some embodiments, the surfaces disclosed herein exhibit a ratio of specific to nonspecific fluorescence signals for a fluorophore such as Cy3 of at least 2, 3, 4, 5, 6, 7, 8, 9, 10, 11, 12, 13, 14, 15, 16, 17, 18, 19, 20, 25, 30, 35, 40, 50, 75, 100, or greater than 100, or any intermediate value spanned by the range herein.

The low-background surfaces consistent with the disclosure herein may exhibit specific dye attachment (e.g., Cy3 attachment) to non-specific dye adsorption (e.g., Cy3 dye adsorption) ratios of at least 4:1, 5:1, 6:1, 7:1, 8:1, 9:1, 10:1, 15:1, 20:1, 30:1, 40:1, 50:1, or more than 50 specific dye molecules attached per molecule nonspecifically adsorbed. Similarly, when subjected to an excitation energy, low-background surfaces consistent with the disclosure herein to which fluorophores, e.g., Cy3, have been attached may exhibit ratios of specific fluorescence signal (e.g., arising from Cy3-labeled oligonucleotides attached to the surface) to non-specific adsorbed dye fluorescence signals of at least 4:1, 5:1, 6:1, 7:1, 8:1, 9:1, 10:1, 15:1, 20:1, 30:1, 40:1, 50:1, or more than 50:1.

In some embodiments, the degree of hydrophilicity (or "wettability" with aqueous solutions) of the disclosed support surfaces may be assessed, for example, through the measurement of water contact angles in which a small droplet of water is placed on the surface and its angle of contact with the surface is measured using, e.g., an optical tensiometer. In some embodiments, a static contact angle may be determined. In some embodiments, an advancing or receding contact angle may be determined. In some embodiments, the water contact angle for the hydrophilic, low-binding support surfaced disclosed herein may range from about 0 degrees to about 30 degrees. In some embodiments, the water contact angle for the hydrophilic, low-binding support surfaced disclosed herein may no more than 50 degrees, 40 degrees, 30 degrees, 25 degrees, 20 degrees, 18 degrees, 16 degrees, 14 degrees, 12 degrees, 10 degrees, 8 degrees, 6 degrees, 4 degrees, 2 degrees, or 1 degree. In many cases the contact angle is no more than 40 degrees. Those of skill in the art will realize that a given hydrophilic, low-binding support surface of the present disclosure may exhibit a water contact angle having a value of anywhere within this range.

In some embodiments, the hydrophilic surfaces disclosed herein facilitate reduced wash times for bioassays, often due to reduced nonspecific binding of biomolecules to the low-binding surfaces. In some embodiments, adequate wash steps may be performed in less than 60, 50, 40, 30, 20, 15, 10, or less than 10 seconds. For example, adequate wash steps may be performed in less than 30 seconds.

Some low-binding surfaces of the present disclosure exhibit significant improvement in stability or durability to prolonged exposure to solvents and elevated temperatures, or to repeated cycles of solvent exposure or changes in temperature. For example, the stability of the disclosed surfaces may be tested by fluorescently labeling a functional group on the surface, or a tethered biomolecule (e.g., an oligonucleotide primer) on the surface, and monitoring fluorescence signal before, during, and after prolonged exposure to solvents and elevated temperatures, or to repeated cycles of solvent exposure or changes in temperature. In some embodiments, the degree of change in the fluorescence used to assess the quality of the surface may be less than 1%, 2%, 3%, 4%, 5%, 10/o, 15%, 20%, or 25% over a time period of 1 minute, 2 minutes, 3 minutes, 4 minutes, 5 minutes, 10 minutes, 20 minutes, 30 minutes, 40 minutes, 50 minutes, 60 minutes, 2 hours, 3 hours, 4 hours, 5 hours, 6 hours, 7 hours, 8 hours, 9 hours, 10 hours, 15 hours, 20 hours, 25 hours, 30 hours, 35 hours, 40 hours, 45 hours, 50 hours, or 100 hours of exposure to solvents and/or elevated temperatures (or any combination of these percentages as measured over these time periods). In some embodiments, the degree of change in the fluorescence used to assess the quality of the surface may be less than 1%, 2%, 3%, 4%, 5%, 10%, 15%, 20%, or 25% over 5 cycles, 10 cycles, 20 cycles, 30 cycles, 40 cycles, 50 cycles, 60 cycles, 70 cycles, 80 cycles, 90 cycles, 100 cycles, 200 cycles, 300 cycles, 400 cycles, 500 cycles, 600 cycles, 700 cycles, 800 cycles, 900 cycles, or 1,000 cycles of repeated exposure to solvent changes and/or changes in temperature (or any combination of these percentages as measured over this range of cycles).

In some embodiments, the surfaces disclosed herein may exhibit a high ratio of specific signal to nonspecific signal or other background. For example, when used for nucleic acid amplification, some surfaces may exhibit an amplification signal that is at least 4, 5, 6, 7, 8, 9, 10, 15, 20, 30, 40, 50, 75, 100, or greater than 100 fold greater than a signal of an adjacent unpopulated region of the surface. Similarly, some surfaces exhibit an amplification signal that is at least 4, 5, 6, 7, 8, 9, 10, 15, 20, 30, 40, 50, 75, 100, or greater than 100 fold greater than a signal of an adjacent amplified nucleic acid population region of the surface.

In some embodiments, fluorescence images of the disclosed low background surfaces when used in nucleic acid hybridization or amplification applications to create polonies of hybridized or clonally-amplified nucleic acid molecules (e.g., that have been directly or indirectly labeled with a fluorophore) exhibit contrast-to-noise ratios (CNRs) of at least 10, 20, 30, 40, 50, 60, 70, 80, 90, 100, 110, 120, 130, 140, 150, 160, 170, 180, 190, 20, 210, 220, 230, 240, 250, or greater than 250.

One or more types of primer may be attached or tethered to the support surface. In some embodiments, the one or more types of adapters or primers may comprise spacer sequences, adapter sequences for hybridization to adapter-ligated target library nucleic acid sequences, forward amplification primers, reverse amplification primers, sequencing primers, and/or molecular barcoding sequences, or any combination thereof. In some embodiments, 1 primer or adapter sequence may be tethered to at least one layer of the surface. In some embodiments, at least 2, 3, 4, 5, 6, 7, 8, 9, 10, or more than 10 different primer or adapter sequences may be tethered to at least one layer of the surface.

In some embodiments, the tethered adapter and/or primer sequences may range in length from about 10 nucleotides to about 100 nucleotides. In some embodiments, the tethered adapter and/or primer sequences may be at least 10, at least 20, at least 30, at least 40, at least 50, at least 60, at least 70, at least 80, at least 90, or at least 100 nucleotides in length. In some embodiments, the tethered adapter and/or primer sequences may be at most 100, at most 90, at most 80, at most 70, at most 60, at most 50, at most 40, at most 30, at most 20, or at most 10 nucleotides in length. Any of the lower and upper values described in this paragraph may be combined to form a range included within the present disclosure, for example, in some embodiments the length of the tethered adapter and/or primer sequences may range from about 20 nucleotides to about 80 nucleotides. Those of skill in the art will recognize that the length of the tethered adapter and/or primer sequences may have any value within this range, e.g., about 24 nucleotides.

In some embodiments, the resultant surface density of primers (e.g., capture primers) on the low binding support surfaces of the present disclosure may range from about 100 primer molecules per $\mu m^2$ to about 100,000 primer molecules per $\mu m^2$. In some embodiments, the resultant surface density of primers on the low binding support surfaces of the present disclosure may range from about 1,000 primer molecules per µm² to about 1,000,000 primer molecules per µm². In some embodiments, the surface density of primers may be at least 1,000, at least 10,000, at least 100,000, or at least 1,000,000 molecules per µm². In some embodiments, the surface density of primers may be at most 1,000,000, at most 100,000, at most 10,000, or at most 1,000 molecules per µm². Any of the lower and upper values described in this paragraph may be combined to form a range included within the present disclosure, for example, in some embodiments the surface density of primers may range from about 10,000 molecules per µm² to about 100,000 molecules per µm². Those of skill in the art will recognize that the surface density of primer molecules may have any value within this range, e.g., about 455,000 molecules per µ². In some embodiments, the surface density of target library nucleic acid sequences initially hybridized to adapter or primer sequences on the support surface may be less than or equal to that indicated for the surface density of tethered primers. In some embodiments, the surface density of clonally-amplified target library nucleic acid sequences hybridized to adapter or primer sequences on the support surface may span the same range as that indicated for the surface density of tethered primers.

Local densities as listed above do not preclude variation in density across a surface, such that a surface may comprise a region having an oligo density of, for example, 500,000/µm², while also comprising at least a second region having a substantially different local density.

In some embodiments, the performance of nucleic acid hybridization and/or amplification reactions using the disclosed reaction formulations and low-binding supports may be assessed using fluorescence imaging techniques, where the contrast-to-noise ratio (CNR) of the images provides a key metric in assessing amplification specificity and non-specific binding on the support. CNR is described in U.S. patent application US 2020/0149095, hereby expressly incorporated by reference in its entirety. CNR is commonly defined as: CNR=(Signal−Background)/Noise. The background term is commonly taken to be the signal measured for the interstitial regions surrounding a particular feature (diffraction limited spot, DLS) in a specified region of interest (ROI). While signal-to-noise ratio (SNR) is often considered to be a benchmark of overall signal quality, it can be shown that improved CNR can provide a significant advantage over SNR as a benchmark for signal quality in applications that require rapid image capture (e.g., sequencing applications for which cycle times must be minimized), as shown in the example below. At high CNR the imaging time required to reach accurate discrimination (and thus accurate base-calling in the case of sequencing applications) can be drastically reduced even with moderate improvements in CNR. Improved CNR in imaging data on the imaging integration time provides a method for more accurately detecting features such as clonally-amplified nucleic acid colonies on the support surface.

In most ensemble-based sequencing approaches, the background term is typically measured as the signal associated with 'interstitial' regions. In addition to "interstitial" background ($B_{inter}$), "intrastitial" background ($B_{intra}$) exists within the region occupied by an amplified DNA colony. The combination of these two background signals dictates the achievable CNR, and subsequently directly impacts the optical instrument requirements, architecture costs, reagent costs, run-times, cost/genome, and ultimately the accuracy and data quality for cyclic array-based sequencing applications. The $B_{inter}$ background signal arises from a variety of sources; a few examples include auto-fluorescence from consumable flow cells, non-specific adsorption of detection molecules that yield spurious fluorescence signals that may obscure the signal from the ROI, the presence of non-specific DNA amplification products (e.g., those arising from primer dimers). In typical next generation sequencing (NGS) applications, this background signal in the current field-of-view (FOV) is averaged over time and subtracted. The signal arising from individual DNA colonies (i.e., (Signal)-B(interstial) in the FOV) yields a discernable feature that can be classified. In some embodiments, the intrastitial background (B(intrastitial)) can contribute a confounding fluorescence signal that is not specific to the target of interest, but is present in the same ROI thus making it far more difficult to average and subtract.

Nucleic acid amplification on the low-binding coated supports described herein may decrease the B(interstitial) background signal by reducing non-specific binding, may lead to improvements in specific nucleic acid amplification, and may lead to a decrease in non-specific amplification that can impact the background signal arising from both the interstitial and intrastitial regions. In some embodiments, the disclosed low-binding coated supports, optionally used in combination with the disclosed hybridization and/or amplification reaction formulations, may lead to improvements in CNR by a factor of 2, 5, 10, 100, 250, 500 or 1000-fold over those achieved using conventional supports and hybridization, amplification, and/or sequencing protocols. Although described here in the context of using fluorescence imaging as the read-out or detection mode, the same principles apply to the use of the disclosed low-binding coated supports and nucleic acid hybridization and amplification formulations for other detection modes as well, including both optical and non-optical detection modes.

Compositions and method for preparing, testing and using the low non-specific binding coatings, including methods for immobilizing to the coating any type of primer (e.g., capture oligonucleotides, amplification oligonucleotides and/or circularization oligonucleotides) are described in U.S. Pat. No. 10,768,173, issued Sep. 8, 2020; U.S. application Ser. No. 16/363,842, filed Mar. 25, 2019; Ser. No. 16/740,355, filed Jan. 10, 2020; Ser. No. 16/740,357, filed Jan. 10, 2020; and U.S. Pat. No. 16,855,877, filed Apr. 22, 2020. The contents of the aforementioned issued patent and patent applications are hereby expressly incorporated by reference in their entireties.

Library Molecules

The pairwise sequencing compositions and methods described herein employ nucleic acid library molecules which typically refers to a population of nucleic acid molecules each comprising a sequence of interest (e.g., insert region) covalently joined to at least one adaptor sequence. Individual library molecules in the population can have an insert sequence that is the same or different insert sequence as other library molecules in the population. Individual library molecules in the population can have an adaptor sequence that is the same (e.g., a universal adaptor sequence) or different (e.g., unique identification sequence) adaptor sequence as other library molecules in the population.

The nucleic acid library molecule comprises DNA, RNA, cDNA or chimeric DNA/RNA. The nucleic acid library molecule can be single-stranded or double-stranded, or can include single-stranded or double-stranded portions. The nucleic acid library molecule can be linear, covalently closed circular, dumbbell, hairpin or other forms.

The insert region of a nucleic acid library molecule comprises a sequence of interest extracted from any source including a biological sample (e.g., fresh or live sample) such as a single cell, a plurality of cells or tissue. The insert region can be isolated from healthy or diseases cells or tissues. The insert region can be obtained from an archived sample such as a fresh frozen paraffin embedded (FFPE) sample, or from needle biopsies, circulating tumor cells, cell free circulating DNA. Cells or tissues are typically treated with a lysis buffer to release their DNA and RNA, and the desired nucleic acid is separated from non-desired macromolecules such as proteins.

The insert region of a nucleic acid library molecule can be isolated in any form, including chromosomal, genomic (e.g., whole genomic), organellar (e.g., mitochondrial, chloroplast or ribosomal), recombinant molecules, cloned or amplified.

The insert region can be prepared using recombinant nucleic acid technology including but not limited to any combination of vector cloning, transgenic host cell preparation, host cell culturing and/or PCR amplification.

The insert region can be prepared using chemical synthesis procedures using native nucleotides with or without nucleotide analogs or modified nucleotide linkages that confer certain properties, including resistance to enzymatic digestion, or increased thermal stability. Examples of nucleotide analogs and modified nucleotide linkages that inhibit nuclease digestion include phosphorothioate, 2'-O-methyl RNA, inverted dT, and 2' 3' dideoxy-dT. Insert regions that include locked nucleic acids (LNA) have increased thermal stability.

The insert region can be isolated from any organism including viruses, fungi, prokaryotes or eukaryotes. The insert region can be isolated from any organism including human, simian, ape, canine, feline, bovine, equine, murine, porcine, caprine, lupine, ranine, piscine, plant, insect or bacteria. The insert region can be isolated from organisms borne in air, water, soil or food.

The insert region can be isolated from any biological fluid, including blood, urine, serum, lymph, tumor, saliva, anal secretions, vaginal secretions, amniotic samples, perspiration, semen, environmental samples or culture samples. The insert region can be isolated from any organ, including head, neck, brain, breast, ovary, cervix, colon, rectum, endometrium, gallbladder, intestines, bladder, prostate, testicles, liver, lung, kidney, esophagus, pancreas, thyroid, pituitary, thymus, skin, heart, larynx, or other organs.

The insert region can be in fragmented or un-fragmented form. Fragmented insert regions can be obtained by mechanical force or enzymatic fragmentation methods. The fragmented insert regions can be generated using procedures that yield a population of fragments having overlapping sequences or non-overlapping sequences.

Mechanical fragmentation typically generates randomly fragmented nucleic acid molecules. Mechanical fragmentation methods include mechanical shearing such as fluid shear, constant shear and pulsatile shear. Mechanical fragmentation methods also include mechanical stress including sonication, nebulization and acoustic cavitation.

Enzymatic fragmentation procedures can be conducted under conditions suitable to generate randomly or non-randomly fragmented nucleic acid molecules. For example, restriction enzyme digestion can be conducted to completion to generate non-randomly fragmented nucleic acid molecule. Alternatively, partial or incomplete restriction enzyme digestion can be conducted to generate randomly-fragmented nucleic acid molecules. Enzymatic fragmentation using restriction enzymes includes any one or any combination of two or more restriction enzymes selected from a group consisting of type I, type II, type IIs, type IIB, type III, or type IV restriction enzymes. Enzymatic fragmentation include use of any combination of a nicking restriction endonuclease, endonuclease and/or exonuclease.

Fragments of the insert region can be generated with PCR using sequence-specific primers that hybridize to target regions in genomic DNA samples to generate insert regions having known fragment lengths and sequences.

Targeted genome fragmentation methods using CRISPR/Cas9 can be used to generate fragmented insert regions.

Fragments of the insert portion can also be generated using a transposase-based tagmentation method using NEXTERA™ (from Epicentre).

The insert region can be single stranded or double stranded. The ends of the double stranded insert region can be blunt-ended, or have a 5' overhang or a 3' overhang end, or any combination thereof. One or both ends of the insert region can be subjected to an enzymatic tailing reaction to generate a non-template poly-A tail by employing a terminal transferase reaction. The ends of the insert region can be compatible for joining to at least one adaptor.

The insert region can be joined at one or both ends to at least one adaptor. Covalent linkage between an insert region and adaptor(s) can be achieved with a DNA or RNA ligase. Exemplary DNA ligases that can ligate double stranded DNA molecules include T4 DNA ligase and T7 DNA ligase. An adaptor sequence can be appended to an insert sequence by PCR using a tailed primer having 5' region carrying an adaptor sequence and a 3' region that is complementary to a portion of the insert sequence. An adaptor sequence can be appended to an insert sequence which is flanked one both sides with first and second adaptor sequences by PCR using a tailed primer having 5' region carrying a third adaptor sequence and a 3' region that is complementary to a portion of the first or second adaptor sequence.

Adaptors comprise DNA or RNA or analogs thereof, or chimeric DNA/RNA. Adaptors can include at least one ribonucleoside residue. Adaptors can be single-stranded, double-stranded, or have single-stranded and/or double-stranded portions.

Adaptors can be configured to be linear, stem-looped, hairpin, or Y-shaped forms. Adaptors can be any length, including 4-100 nucleotides or longer.

Adaptors can have blunt ends, overhang ends, or a combination of both. Overhang ends include 5' overhang and 3' overhang ends. The 5' end of a single-stranded adaptor, or one strand of a double-stranded adaptor, can have a 5' phosphate group or lack a 5' phosphate group. Adaptors can include a 5' tail that does not hybridize to a target polynucleotide (e.g., tailed adaptor), or adaptors can be non-tailed.

An adaptor can include a sequence (e.g., a universal adaptor sequence) that is complementary to at least a portion of a primer, such as an amplification primer, a sequencing primer, an immobilized surface capture primer or a soluble primer.

Adaptors can include a random sequence or degenerate sequence. Adaptors can include at least one inosine residue.

Adaptors can be synthesized to include nucleotide analogs or modified nucleotide linkages that confer certain properties, including resistance to enzymatic degradation, or increased thermal stability. Examples of nucleotide analogs and modified nucleotide linkages that inhibit nuclease digestion include phosphorothioate, 2'-O-methyl RNA, inverted dT, or 2' 3' dideoxy-dT. Adaptors that include locked nucleic acids (LNA) have increased thermal stability. Adaptors can include at least one phosphorothioate, phosphorothiolate and/or phosphoramidate linkage.

Adaptors can include at least one restriction enzyme recognition sequence, including any one or any combination of two or more selected from a group consisting of type I, type II, type III, type IV, type IIs or type IIB.

Adaptors can include a sample barcode sequence which is used to distinguish polynucleotides (e.g., insert sequences) from different sample sources in a multiplex assay. Adaptors can include a unique identification sequence (e.g., a molecular tag, unique molecular index, UMI) that is used to uniquely identify an individual nucleic acid molecule (e.g., insert sequence) to which the adaptor is appended in a population of other nucleic acid molecules joined to other distinguishing unique identification sequence adaptors.

In some embodiments, a single stranded nucleic acid library molecule can serve as a template molecule for sequencing analysis. In some embodiments, a complementary strand of the nucleic acid library molecule can be synthesized and the complementary strand can serve as a template molecule for sequencing analysis. In some embodiments, a single stranded nucleic acid library molecule can be amplified and the resulting amplicon strands can serve as template molecules for sequencing analysis. In some embodiments, double-stranded library molecules can be denatured or subjected to enzymatic treatment to generate a single stranded library molecule which can be subjected to binding and/or sequencing analysis.

In some embodiments, a single stranded circular library molecule can be hybridized to an amplification primer (e.g., a surface primer) and subjected to a primer extension reaction to generate a complementary concatemer molecule, where the concatemer molecule serves as a template molecule for sequencing analysis. The sequencing analysis of the concatemer molecule can generate a complementary strand which can in turn serve as a template molecule for sequencing analysis. In some embodiments, a copy of the complementary strand can serve as a template molecule for sequencing analysis.

Circularization of Library Molecules

Individual linear library molecules comprise an insert sequence flanked at both ends with at least one adaptor sequence. A population of single stranded linear library molecules can be circularized to generate covalently closed circular library molecules. For example, the ends of the single-stranded linear library molecules can undergo intramolecular ligation using a single-stranded ligase (e.g., CircLigase from Epicentre or Lucigen).

In some embodiments, circular DNA molecules can be generated using a protelomerase instead of a nucleic acid ligase. Protelomerase enzymes identifies a enzyme recognition sequence within a nucleic acid molecule, cleaves the enzyme recognition sequence to generate an end having a 5' and 3' exposed cleavage ends, rejoins 5' and 3' cleavage ends of a single exposed end at the enzyme recognition site to form a single linear molecule from the cleaved 5' and 3' ends. When this reaction is performed on both ends of a double-stranded nucleic acid molecule having the enzyme recognition sequence at each end, the result is a circular nucleic acid molecule. An adaptor carrying the enzyme recognition sequence can be joined to both ends of the double-stranded DNA molecule via ligation or PCR using tailed PCR primers. A number of enzymes or enzyme combinations are compatible with this reaction, including a protelomerase. One type of protelomerase is TelN protelomerase, such as that from E. coli phage NI.

In some embodiments, a population of double-stranded linear library molecules can be circularized to generate circular library molecules. Individual linear library molecules comprise an insert sequence flanked at both ends with at least one adaptor sequence. In some embodiments, the population of linear library molecules can be contacted with an enzyme that catalyzes 5' phosphorylation of the ends of the linear molecules, such as for example T4 polynucleotide kinase. In some embodiments, the population of linear molecules having blunt ends can be contacted with a ligase enzyme for intramolecular ligation, where the ligase enzyme comprises T3 or T4 DNA ligase. In some embodiments, the population of linear molecules have overhang ends (e.g., sticky ends) can be contacted with a T7 DNA ligase to generate circular molecules. In some embodiments, the linear library molecules can be reacted with the T4 polynucleotide kinase enzyme and the ligase enzyme either sequentially or simultaneously to generate circular molecules. The non-circular molecules can be degraded using at least one exonuclease enzyme, such as for example T7 exonuclease and/or exonuclease I (e.g., thermolabile exonuclease I).

In some embodiments, a padlock probe workflow can be used to generate single stranded circular molecules. Typically, in the padlock probe the arrangement of the insert sequence (sequence of interest) and adaptors differs from a standard linear library molecule. In some embodiments, that padlock probe comprises a single-stranded linear oligonucleotide having a 5' portion, an internal linker portion, and a 3' portion. The 5' and 3' portions each comprise a portion of a target sequence of interest. The 5' and 3' portions are separately complementary to a target sequence of interest (e.g., a contiguous target sequence of interest), while the linker portion is designed to have little or no complementarity to the target sequence. The 5' and 3' ends of the padlock probe can hybridize to adjacent positions on the target nucleic acid molecule to form an open circularized molecule with a nick between the hybridized 5' and 3' ends. The nick can be ligated to generate a covalently close circular molecule. Alternatively, the 5' and 3' ends of the padlock probe can hybridize to adjacent positions on the target nucleic acid molecule to form an open circularized molecule with a gap between the hybridized 5' and 3' ends. The gap can be subject to a polymerase-mediated filled-in reaction to form a nick, and the nick can be ligated to generate a covalently close circular molecule. The covalently closed circular molecule can be subjected to a rolling circle amplification reaction to generate a concatemer having tandem repeat regions containing the sequence of interest. The internal linker portion can be engineered to include one or more universal adaptor sequences, barcode adaptors or unique identifier adaptors.

In some embodiments, a population of the single stranded linear library molecules can be circularized to generate single stranded circular library molecules. Individual single stranded linear library molecules comprise an insert sequence flanked at both ends with at least one adaptor sequence. For example, the single stranded linear library molecules comprises the arrangement: 5'—first surface primer binding sequence (SP1); first sequencing primer binding sequence (Seq1); insert sequence (sequence of interest); second sequencing primer binding sequence (Seq2); second surface primer binding sequence (SP2)-3' (e.g., see FIG. 53 left top schematic). The population of double stranded linear library molecules can be denatured to generate single stranded linear library molecules. The single stranded linear library molecules can be hybridized to partially double stranded splint molecules to generate circular library molecules with gaps. The partially double stranded splint molecules comprise double stranded oligonucleotides having a first splint strand (long strand) and a second splint strand (short strand) (e.g., see FIG. 53, left bottom schematic). In some embodiments, the first splint strand comprises: (i) a left sequence that hybridizes to a first surface primer binding sequence (SP1'); (ii) an internal portion that hybridizes to the second splint strand; and (iii) a right sequence that hybridizes to a second surface primer binding sequence (SP2') (e.g., see FIG. 53). In some embodiments, the internal portion of the first splint strand comprises a complementary sequence of a sample barcode and/or a unique identification sequence (N'N'N'). In some embodiments, the second splint strand comprises a sequence that hybridizes to the internal portion of the first splint strand. The second splint strand can include a sample barcode and/or unique identification sequence (NNN). The insert sequence of interest does not hybridize to the first or second splint strands (FIG. 53).

A single stranded library molecule hybridizes to a double stranded splint molecule to generate a library-splint complex having two nicks (FIG. 54). The first nick is located between the 5' end of the library molecule and the 3' end of the second splint strand. The second nick is located between the 3' end of the library molecule and the 5' end of the second splint strand (FIG. 54, left schematic).

The library-splint complexes can be reacted with T4 polynucleotide kinase and a ligase (e.g., T7 DNA ligase) either sequentially or simultaneously, to (i) phosphorylate the 5' end of the library molecule, the 5' end of the first splint strand, and the 5' end of the second splint strand, and to (ii) close the first and second nicks by enzymatic ligation, thereby generating a single stranded covalently closed circular library molecule which is hybridized to the second splint strand (FIG. 54, center schematic). The non-circular molecules and the second splint strands can be degraded using at least one exonuclease enzyme, such as for example T7 exonuclease and/or exonuclease I (e.g., thermolabile exonuclease I). The remaining single stranded circular library molecules can be subjected to a rolling circle amplification reaction, either in-solution or on-support, using the 3' end of the linear first splint strand (FIG. 54, right schematic). Alternatively, the first splint strand can be removed and the closed circular molecule can be hybridized with a soluble amplification primer which can be used to initiate a rolling circle amplification reaction. In another example, the first splint strand can be removed and the closed circular molecule can be hybridized with an immobilized surface primer on a support and then subjected to a rolling circle amplification reaction. The surface primers that are immobilized to the support lack a nucleotide having a scissile moiety. For example, the surface primers lack uridine, 8-oxo-7,8-dihydroguanine (e.g., 8oxoG) and deoxyinosine.

Compaction Oligonucleotides

Any of the on-support or in-solution rolling circle amplification reactions described herein can include a plurality of compaction oligonucleotides which can compact the size and/or shape of the concatemer into a nanoball. The compaction oligonucleotide is a single-stranded nucleic acid molecule comprising DNA or analogs thereof. The compaction oligonucleotide can cross-hybridize to portions of the concatemer molecule. The compaction oligonucleotide comprises two identical sequences separated by a short linker sequence, where the two identical sequences are reverse-complementary to a portion of the concatemer. The compaction oligonucleotide can be any length, for example 20-100 nucleotides. The two identical sequence regions of the compaction oligonucleotide can hybridize to the concatemer to pull together distal portions of the concatemer causing compaction of the concatemer to form a nanoball. In some embodiments, the compaction oligonucleotide is resistant to 3' exonuclease degradation and/or single-stranded endonuclease degradation. In some embodiments, the compaction oligonucleotide comprises any one or any combination of two or more of: 3' terminal end phosphorylation; at least two 3' terminal end nucleotides having a phosphorothioate bond therebetween; at least one 3' terminal end nucleotide having a 2'-O-methyl moiety; and/or at least one 3' terminal nucleotide having a 2' fluoro base.

The compaction oligonucleotides can include at least one region having consecutive guanines. For example, the compaction oligonucleotides can include at least one region having 2, 3, 4, 5, 6 or more consecutive guanines. In some embodiments, the compaction oligonucleotides comprise four consecutive guanines which can form a guanine tetrad structure (see FIG. 116A). The guanine tetrad structure can be stabilized via Hoogsteen hydrogen bonding. The guanine tetrad structure can be stabilized by a central cation including potassium, sodium, lithium, rubidium or cesium.

In some embodiments, the rolling circle amplification reaction can be conducted with circular library molecules comprising a sequence of interest and a universal binding sequence for a compaction oligonucleotide, and further comprising any one or any combination of two or more of: (i) two or more copies of a universal binding sequence for a soluble forward sequencing primer, (ii) two or more copies of a universal binding sequence for a soluble reverse sequencing primer, (iii) two or more copies of a universal binding sequence for an immobilized first surface primer, (iv) two or more copies of a universal binding sequence for an immobilized second surface primer, (v) two or more copies of a universal binding sequence for a first soluble amplification primer, (vi) two or more copies of a universal binding sequence for a second soluble amplification primer, (vii) two or more copies of a sample barcode sequence and/or (viii) two or more copies of a unique molecular index sequence.

The rolling circle amplification reaction can be conducted in the presence of a plurality of compaction oligonucleotides having at least four consecutive guanines. The resulting concatemers comprise repeat copies of the universal binding sequence for the compaction oligonucleotide. At least one compaction oligonucleotide can form a guanine tetrad (FIG. 116A) and hybridize to the universal binding sequences for the compaction oligonucleotide, and the resulting concatemer can fold to form an intramolecular G-quadruplex structure (FIG. 116B). The concatemers can self-collapse to form compact nanoballs. Formation of the guanine tetrads and G-quadruplexes in the nanoballs may increase the stability of the nanoballs to retain their compact size and shape which can withstand repeated flows of reagents for conducting any of the pairwise sequencing workflows described herein.

On-Support Rolling Circle Amplification

The present disclosure provides pairwise sequencing compositions and methods which employ on-support rolling circle amplification to generate a plurality of immobilized single stranded nucleic acid concatemer template molecules. In some embodiments, the on-support rolling circle amplification reaction comprises: (1) hybridizing a plurality of single-stranded covalently closed circular nucleic acid library molecules to the plurality of immobilized surface primers thereby generating a plurality of immobilized covalently closed circular nucleic acid library molecules; (2) forming a plurality of nucleotide-polymerase complexes by contacting the plurality of immobilized covalently closed circular nucleic acid library molecules with (i) a plurality of polymerases having strand displacement activity, (ii) a plurality of nucleotides comprising a mixture of dATP, dGTP, dCTP, dTTP and a nucleotide analog having a scissile moiety, and (iii) a catalytic divalent cation that mediates nucleotide binding to the nucleotide-polymerase complexes and promotes nucleotide incorporation (e.g., magnesium and/or manganese), wherein the contacting is conducted under a condition suitable for binding individual polymerases to an immobilized covalently closed circular nucleic acid library molecule to form complexed polymerases and the condition is suitable for binding individual complexed polymerases to a nucleotide or nucleotide analog to form the nucleotide-polymerase complexes. In some embodiments, in the nucleotide mixture of the plurality of nucleotides, the nucleotide having the scissile moiety comprises uridine, 8-oxo-7,8-dihydroguanine (e.g., 8oxoG) or deoxyinosine; and (3) conducting a nucleotide polymerization reaction (e.g., rolling circle amplification reaction) under an isothermal temperature condition to generate a plurality of immobilized single stranded concatemer template molecules.

In some embodiments, the rolling circle amplification reaction lacks a plurality of compaction oligonucleotides, or the rolling circle amplification reaction further comprises a plurality of compaction oligonucleotides that can hybridize to portions of the concatemer to collapse the concatemer into a more compact shape and size. The compaction oligonucleotide is a single-stranded nucleic acid molecule having two identical sequences separated by a short linker sequence, where the two identical sequences are reverse-complementary to a portion of the concatemer. The compaction oligonucleotide can be any length, for example 20-100 nucleotides. The two identical sequence regions of the compaction oligonucleotide can hybridize to the concatemer to pull together distal portions of the concatemer causing compaction of the concatemer. In some embodiments, the compaction oligonucleotide is resistant to 3' exonuclease degradation and/or single-stranded endonuclease degradation. In some embodiments, the compaction oligonucleotide comprises any one or any combination of two or more of: 3' terminal end phosphorylation; at least two 3' terminal end nucleotides having a phosphorothioate bond therebetween; at least one 3' terminal end nucleotide having a 2'-O-methyl moiety; and/or at least one 3' terminal nucleotide having a 2' fluoro base. In some embodiments, the compaction oligonucleotides can be included in step (2) or (3).

In some embodiments, the plurality of polymerases having strand displacement activity comprise phi29 DNA polymerase, large fragment of Bst DNA polymerase, large fragment of Bsu DNA polymerase, and Bca (exo-) DNA polymerase, Klenow fragment of E. coli DNA polymerase, T5 polymerase, M-MuLV reverse transcriptase, HIV viral reverse transcriptase, or Deep Vent® DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio).

In some embodiments, the rolling circle amplification reaction further comprises at least one accessory protein or enzyme, including helicase, single-stranded binding (SSB) protein, or recombinase (e.g., T4 uvsX) and/or recombinase accessory factor (e.g., T4 uvsY or T4 gp32).

In some embodiments, the rolling circle amplification reaction can be conducted at an isothermal temperature of about 30, 31, 32, 33, 34, 35, 36, 37, 38, 39 or 40° C.

In some embodiments, the concatemer can contain at least 2, 5, 10, 50, 100, 200, 500, 1000, 2000, 3000, 4000, 5000, 6000, 7000, 8000, 9000, 10,000, or more tandem copies of repeat units which include the of the sequence of interest (or complementary sequence thereof) and any adaptor sequences (or complementary sequence thereof) present in the original covalently closed circular nucleic acid library molecules.

In some embodiments, the rolling circle amplification (RCA) reaction can be followed by a multiple displacement amplification (MDA) reaction or a flexing amplification reaction. In some embodiments, the RCA reaction is not followed by a multiple displacement amplification reaction or a flexing amplification reaction. Exemplary MDA and flexing reactions are described below.

On-Support Two-Stage Rolling Circle Amplification Trapped Nucleotide-Polymerase Complexes The present disclosure provides pairwise sequencing compositions and methods which employ an on-support two-stage rolling circle amplification reactions to generate a plurality of immobilized single stranded nucleic acid concatemer template molecules. The two-stage rolling circle amplification methods described herein employs non-catalytic and then catalytic divalent cations to synchronize the rolling circle amplification events on a surface/support and generate concatemers. The two-stage rolling circle amplification reaction can be followed by a relaxant condition and a flexing amplification reaction which generates new concatemers from the existing concatemers. Together, these amplification methods generate highly compact nanoballs containing high copy number of the target sequence which improves sequencing signal intensity.

In some embodiments, the on-support two-stage rolling circle amplification reaction comprises: (1) hybridizing a plurality of single-stranded covalently closed circular nucleic acid library molecules to the plurality of immobilized surface primers thereby generating a plurality of immobilized covalently closed circular nucleic acid library molecules; (2) forming a plurality of trapped nucleotide-polymerase complexes by contacting the plurality of immobilized covalently closed circular nucleic acid library molecules with (i) a plurality of polymerases having strand displacement activity, (ii) a first plurality of nucleotides comprising a mixture of dATP, dGTP, dCTP, dTTP and a nucleotide analog having a scissile moiety, and (iii) a non-catalytic divalent cation that mediates nucleotide binding to the trapped nucleotide-polymerase complexes but not nucleotide incorporation (e.g., strontium or barium), wherein the contacting is conducted under a condition suitable for binding individual polymerases to an immobilized covalently closed circular nucleic acid library molecule to form complexed polymerases and the condition is suitable for binding individual complexed polymerases to a nucleotide or nucleotide analog to form the trapped nucleotide-polymerase complexes. In some embodiments, in the nucleotide mixture of the first plurality of nucleotides, the nucleotide having the scissile moiety comprises uridine, 8-oxo-7,8-dihydroguanine (e.g., 8oxoG) or deoxyinosine. The rolling circle amplification reaction further comprises: (3) conducting a nucleotide polymerization reaction by contacting the plurality of trapped nucleotide-polymerase complexes with (i) at least one divalent cation that mediates nucleotide binding and mediates nucleotide incorporation (e.g., magnesium and/or manganese), and (ii) a second plurality of nucleotides comprising a mixture of dATP, dGTP, dCTP, dTTP and a nucleotide analog having a scissile moiety, under a condition suitable for conducting an isothermal rolling circle amplification reaction to generate a plurality of immobilized single stranded concatemer template molecules. In some embodiments, in the nucleotide mixture of the second plurality of nucleotides, the nucleotide analog having the scissile moiety comprises uridine, 8-oxo-7,8-dihydroguanine (e.g., 8oxoG) or deoxyinosine.

In some embodiments, the two-stage rolling circle amplification reaction lacks a plurality of compaction oligonucleotides, or the rolling circle amplification reaction further comprises a plurality of compaction oligonucleotides that can hybridize to portions of the concatemer to collapse the concatemer into a more compact shape and size. The compaction oligonucleotide is a single-stranded nucleic acid molecule having two identical sequences separated by a short linker sequence, where the two identical sequences are reverse-complementary to a portion of the concatemer. The compaction oligonucleotide can be any length, for example 20-100 nucleotides. The two identical sequence regions of the compaction oligonucleotide can hybridize to the concatemer to pull together distal portions of the concatemer causing compaction of the concatemer. In some embodiments, the compaction oligonucleotide is resistant to 3' exonuclease degradation and/or single-stranded endonuclease degradation. In some embodiments, the compaction oligonucleotide comprises any one or any combination of two or more of: 3' terminal end phosphorylation; at least two 3' terminal end nucleotides having a phosphorothioate bond therebetween; at least one 3' terminal end nucleotide having a 2'-O-methyl moiety; and/or at least one 3' terminal nucleotide having a 2' fluoro base. In some embodiments, the compaction oligonucleotides can be included in step (2) or (3).

In some embodiments, in the trapped nucleotide-polymerase mixture of step (2), the plurality of polymerases having strand displacement activity comprise phi29 DNA polymerase, large fragment of Bst DNA polymerase, large fragment of Bsu DNA polymerase, and Bca (exo-) DNA polymerase, Klenow fragment of E. coli DNA polymerase, T5 polymerase, M-MuLV reverse transcriptase, HIV viral reverse transcriptase, or Deep Vent® DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio).

In some embodiments, the on-support two-stage rolling circle amplification reaction further comprises at least one accessory protein or enzyme, including helicase, single-stranded binding (SSB) protein, or recombinase (e.g., T4 uvsX) and/or recombinase accessory factor (e.g., T4 uvsY or T4 gp32).

In some embodiments, the on-support two-stage rolling circle amplification reaction can be conducted at an isothermal temperature of about 30, 31, 32, 33, 34, 35, 36, 37, 38, 39 or 40° C.

In some embodiments, the concatemer can contain at least 2, 5, 10, 50, 100, 200, 500, 1000, 2000, 3000, 4000, 5000, 6000, 7000, 8000, 9000, 10,000, or more tandem copies of repeat units which include the of the sequence of interest (or complementary sequence thereof) and any adaptor sequences (or complementary sequences thereof) present in the original covalently closed circular nucleic acid library molecules.

In some embodiments, the on-support two-stage rolling circle amplification (RCA) reaction with trapped nucleotide-polymerase complexes can be followed by a multiple displacement amplification (MDA) reaction or a flexing amplification reaction. In some embodiments, the RCA reaction with trapped nucleotide-polymerase complexes is not followed by a multiple displacement amplification reaction or a flexing amplification reaction. Exemplary MDA and flexing reactions are described below.

In-Solution Initiated Two-Stage Rolling Circle Amplification

Trapped Nucleotide-Polymerase Complexes

The present disclosure provides pairwise sequencing compositions and methods which employ an in-solution two-stage rolling circle amplification reactions to generate a plurality of single stranded nucleic acid concatemer template molecules. The two-stage rolling circle amplification methods described herein employs non-catalytic and then catalytic divalent cations to synchronize the rolling circle amplification events in-solution and generate concatemers. The concatemers generated in-solution using the two-stage rolling circle amplification reaction can be distributed onto a support having surface primers immobilized thereon. The concatemers can hybridize to the immobilized surface primers, and the rolling circle amplification reaction can continue on the support. These amplification methods generate highly compact nanoballs containing high copy number of the target sequence which improves sequencing signal intensity.

In some embodiments, the in-solution two-stage rolling circle amplification reaction comprises: (1) forming templates-primer duplexes by hybridizing in-solution circular nucleic acid library molecules with soluble first amplification primers; (2) forming a plurality of trapped nucleotide-polymerase complexes by contacting the template-primer duplexes with (i) a plurality of polymerases having strand displacing activity, (ii) a first plurality of nucleotides comprising a mixture of dATP, dGTP, dCTP, dTTP and a nucleotide analog having a scissile moiety, and (iii) a non-catalytic divalent cation that mediates nucleotide binding to the trapped nucleotide-polymerase complexes but not nucleotide incorporation (e.g., strontium or barium), wherein the contacting is conducted under a condition suitable for binding individual polymerases to an immobilized covalently closed circular nucleic acid library molecule to form complexed polymerases and the condition is suitable for binding individual complexed polymerases to a nucleotide or nucleotide analog to form the trapped nucleotide-polymerase complexes. In some embodiments, in the nucleotide mixture of the first plurality of nucleotides, the nucleotide having the scissile moiety comprises uridine, 8-oxo-7,8-dihydroguanine (e.g., 8oxoG) or deoxyinosine. The rolling circle amplification reaction further comprises: (3) conducting a nucleotide polymerization reaction by contacting the plurality of trapped nucleotide-polymerase complexes with (i) at least one divalent cation that mediates nucleotide binding and mediates nucleotide incorporation (e.g., magnesium and/or manganese), and (ii) a second plurality of nucleotides comprising a mixture of dATP, dGTP, dCTP, dTTP and a nucleotide analog having a scissile moiety, under a condition suitable for conducting an isothermal rolling circle amplification reaction to generate a plurality of immobilized single stranded concatemer template molecules. In some embodiments, in the nucleotide mixture of the second plurality of nucleotides, the nucleotide analog having the scissile moiety comprises uridine, 8-oxo-7,8-dihydroguanine (e.g., 8oxoG) or deoxyinosine. The in-solution RCA reaction can be conducted for an amount of time suitable to generate a plurality of concatemers hybridized to their respective circular library molecules which are then distributed onto the support having a plurality of surface primers immobilized thereon. The in-solution RCA reaction can be conducted for a very short period of time, for a moderate period of time, or for longer periods of time, prior to distributing onto the support.

In some embodiments, the two-stage rolling circle amplification reaction lacks a plurality of compaction oligonucleotides, or the rolling circle amplification reaction further comprises a plurality of compaction oligonucleotides that can hybridize to portions of the concatemer to collapse the concatemer into a more compact shape and size. The compaction oligonucleotide is a single-stranded nucleic acid molecule having two identical sequences separated by a short linker sequence, where the two identical sequences are reverse-complementary to a portion of the concatemer. The compaction oligonucleotide can be any length, for example 20-100 nucleotides. The two identical sequence regions of the compaction oligonucleotide can hybridize to the concatemer to pull together distal portions of the concatemer causing compaction of the concatemer. In some embodiments, the compaction oligonucleotide is resistant to 3' exonuclease degradation and/or single-stranded endonuclease degradation. In some embodiments, the compaction oligonucleotide comprises any one or any combination of two or more of: 3' terminal end phosphorylation; at least two 3' terminal end nucleotides having a phosphorothioate bond therebetween; at least one 3' terminal end nucleotide having a 2'-O-methyl moiety; and/or at least one 3' terminal nucleotide having a 2' fluoro base. In some embodiments, the compaction oligonucleotides can be included in step (2) or (3).

In some embodiments, in the trapped nucleotide-polymerase mixture of step (2), the plurality of polymerases having strand displacement activity comprise phi29 DNA polymerase, large fragment of Bst DNA polymerase, large fragment of Bsu DNA polymerase, and Bca (exo-) DNA polymerase, Klenow fragment of E. coli DNA polymerase, T5 polymerase, M-MuLV reverse transcriptase, HIV viral reverse transcriptase, or Deep Vent® DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio).

In some embodiments, the in-solution two-stage rolling circle amplification reaction further comprises at least one accessory protein or enzyme, including helicase, single-stranded binding (SSB) protein, or recombinase (e.g., T4 uvsX) and/or recombinase accessory factor (e.g., T4 uvsY or T4 gp32).

In some embodiments, the in-solution two-stage rolling circle amplification reaction can be conducted at an isothermal temperature of about 30, 31, 32, 33, 34, 35, 36, 37, 38, 39 or 40° C.

In some embodiments, the concatemer can contain at least 2, 5, 10, 50, 100, 200, 500, 1000, 2000, 3000, 4000, 5000, 6000, 7000, 8000, 9000, 10,000, or more tandem copies of repeat units which include the of the sequence of interest (or complementary sequence thereof) and any adaptor sequences (or complementary sequences thereof) present in the original covalently closed circular nucleic acid library molecules.

In some embodiments, the in-solution two-stage rolling circle amplification (RCA) reaction with trapped nucleotide-polymerase complexes can be followed by an in-solution multiple displacement amplification (MDA) reaction or an on-support flexing amplification reaction. In some embodiments, the in-solution RCA reaction with trapped nucleotide-polymerase complexes is not followed by a multiple displacement amplification reaction or a flexing amplification reaction. Exemplary MDA and flexing reactions are described below.

Multiple Displacement Amplification Reaction with Random-Sequence Primers

In some embodiments, the on-support or the in-solution two-stage rolling circle amplification methods can optionally be followed by a multiple displacement amplification reaction which employs random-sequence soluble primers. The multiple displacement amplification reaction comprises: (1) forming a multiple displacement amplification (MDA) reaction mixture by contacting the plurality of immobilized single stranded concatemer template molecules with (i) a second plurality of polymerases having strand displacement activity, and (ii) a plurality of soluble amplification primers wherein individual amplification primers in the plurality are exonuclease-resistant and have a 3' OH extendible end and comprise a random sequence that can hybridize to a portion of the concatemer template molecules, (iii) a third plurality of nucleotides comprising a mixture of dATP, dGTP, dCTP, dTTP and optionally a nucleotide analog having a scissile moiety, and (iv) at least one divalent cation that mediates nucleotide binding and mediates nucleotide incorporation (e.g., magnesium and/or manganese); and (2) conducting an isothermal multiple displacement amplification (MDA) reaction to generate a plurality of immobilized branched concatemers. In some embodiments, the nucleotide analog having the scissile moiety comprises uridine, 8-oxo-7,8-dihydroguanine (e.g., 8oxoG) or deoxyinosine.

In some embodiments, in the multiple displacement amplification (MDA) reaction mixture, the second plurality of polymerases having strand displacement activity comprises phi29 DNA polymerase, large fragment of Bst DNA polymerase, large fragment of Bsu DNA polymerase, and Bca (exo-) DNA polymerase, Klenow fragment of E. coli DNA polymerase, T5 polymerase, M-MuLV reverse transcriptase, HIV viral reverse transcriptase, or Deep Vent® DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio).

In some embodiments, in the multiple displacement amplification (MDA) reaction mixture, the plurality of amplification primers comprise single-stranded nucleic acid primers having a length of about 5-25 nucleotides. In some embodiments, the plurality of soluble amplification primers comprise non-protected single-stranded nucleic acid primers. In some embodiments, the plurality of soluble amplification primers comprise protected single-stranded nucleic acid primers that are resistant to 3' exonuclease degradation and/or single-stranded endonuclease degradation. In some embodiments, the plurality of soluble amplification primers comprise any one or any combination of two or more of: 3' terminal end phosphorylation; at least two 3' terminal end nucleotides having a phosphorothioate bond therebetween; at least one 3' terminal end nucleotide having a 2'-O-methyl moiety; and/or at least one 3' terminal nucleotide having a 2' fluoro base. In some embodiments, the plurality of soluble amplification primers comprise a population of primers having the same length, for example a length of 6 or 9 nucleotides. In some embodiments, the plurality of soluble amplification primers comprise a population of primers having a mixture of different lengths, for example a mixture comprising 6-mer and 9-mer primers. In some embodiments, the plurality of soluble amplification primers comprise a mixture of primers having random sequences including up to $4^6$ different sequences (e.g., for the 6-mers) or $4^9$ different sequences (e.g., for the 9-mers).

In some embodiments, the multiple displacement amplification (MDA) reaction mixture can further comprise at least one accessory protein or enzyme, including helicase, single-stranded binding (SSB) protein, or recombinase (e.g., T4 uvsX) and/or recombinase accessory factor (e.g., T4 uvsY or T4 gp32).

In some embodiments, the multiple displacement amplification (MDA) reaction can be conducted at an isothermal temperature of about 30, 31, 32, 33, 34, 35, 36, 37, 38, 39, 40, 41, 42, 43, 44 or 45° C.

Multiple Displacement Amplification Reaction with Primase-Polymerase

In some embodiments, the on-support or the in-solution two-stage rolling circle amplification methods can optionally be followed by a multiple displacement amplification reaction which employs a primase-polymerase enzyme. The multiple displacement amplification reaction comprises: (1) forming a multiple displacement amplification (MDA) reaction mixture by contacting the plurality of immobilized single stranded concatemer template molecules with (i) a second plurality of polymerases having strand displacement activity, (ii) a plurality of DNA primase-polymerase enzymes, (iii) a third plurality of nucleotides comprising a mixture of dATP, dGTP, dCTP, dTTP and optionally a nucleotide analog having a scissile moiety, and (iv) at least one divalent cation that mediates nucleotide binding and mediates nucleotide incorporation (e.g., magnesium and/or manganese), and (2) conducting an isothermal multiple displacement amplification (MDA) reaction to generate a plurality of immobilized branched concatemers. In some embodiments, the multiple displacement amplification reaction is conducted without added amplification primers (e.g., a primerless reaction). In some embodiments, the nucleotide analog having the scissile moiety comprises uridine, 8-oxo-7,8-dihydroguanine (e.g., 8oxoG) or deoxyinosine.

In some embodiments, in the multiple displacement amplification (MDA) reaction mixture, the second plurality of polymerases having strand displacement activity comprises phi29 DNA polymerase, large fragment of Bst DNA polymerase, large fragment of Bsu DNA polymerase, and Bca (exo-) DNA polymerase, Klenow fragment of *E. coli* DNA polymerase, T5 polymerase, M-MuLV reverse transcriptase, HIV viral reverse transcriptase, or Deep Vent® DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio).

In some embodiments, the plurality of DNA primase-polymerase enzymes comprise an enzyme from *Thermus thermophilus* HB27 (e.g., Tth PrimPol enzyme).

In some embodiments, the multiple displacement amplification (MDA) reaction mixture further comprises at least one accessory protein or enzyme, including helicase, single-stranded binding (SSB) protein, or recombinase (e.g., T4 uvsX) and/or recombinase accessory factor (e.g., T4 uvsY or T4 gp32).

In some embodiments, the multiple displacement amplification (MDA) reaction can be conducted at an isothermal temperature of about 30, 31, 32, 33, 34, 35, 36, 37, 38, 39, 40, 41, 42, 43, 44 or 45° C.

Flexing Amplification

In some embodiments, the immobilized single stranded concatemer template molecules that are generated by the on-support or the in-solution two-stage rolling circle amplification methods can optionally be subjected to a two stage flexing amplification method on the support, which comprises contacting the immobilized single stranded concatemer template molecules with nucleic acid relaxing agents (first stage) and then conducting a flexing amplification reaction during the second stage. Without wishing to be bound by theory, it is postulated that the nucleic acid relaxing agent(s) can disrupt hydrogen bonding (e.g., denaturation) in the plurality of immobilized concatemer template molecules which causes the structure of the nucleic acid concatemers to relax and increases the number of new duplex formations between the immobilized surface primers and portions of the nucleic acid concatemers, thereby increasing the opportunity to generate new concatemers from the duplexed immobilized surface primers. The new concatemers can be generated during the flexing amplification reaction. The inclusion of the relaxing agents can cause nucleic acid denaturation without use of denaturation temperatures or denaturation chemicals.

In general, the amplification method comprises: (1) conducting on-support rolling circle amplification (e.g., two-stage RCA) to generate a plurality of immobilized single stranded concatemer template molecules; (2) forming a relaxant reaction mixture with a temperature ramp-up and ramp-down followed by washing; (3) forming a flexing amplification reaction mixture; (4) conducting a flexing amplification reaction on the support (e.g., with no added soluble primers) to generate a plurality of double-stranded concatemers; (5) washing; and (6) repeating steps (2)-(5) at least once.

In some embodiments, the flexing amplification method comprises: (1) conducting the on-support rolling circle amplification thereby generating a plurality of immobilized single stranded concatemer template molecules; (2) forming a relaxant reaction mixture under a condition suitable for increasing the number of duplex formations between the immobilized surface primers (e.g., that are not yet hybridized to a covalently closed circular nucleic acid library molecule or not covalently linked to a single stranded concatemer template molecule) and portions of the single-stranded concatemer template molecules, by contacting the single-stranded concatemer template molecules with at least one nucleic acid relaxing reagent under a temperature ramp-up condition, a relaxant incubation condition, and a temperature ramp-down condition, and followed by a washing step; (3) forming a flexing amplification reaction mixture by contacting the single-stranded concatemers template molecules with (i) a plurality of polymerases having strand displacement activity, (ii) a plurality of nucleotides wherein the concentration of the plurality of nucleotides is at least at the threshold concentration, or exceeds the threshold concentration, to promote nucleotide polymerization, (iii) a divalent cation that mediates nucleotide binding and mediates nucleotide polymerization (e.g., magnesium and/or manganese), wherein the flexing reaction mixture contains no added soluble amplification primers; (4) conducting a flexing amplification reaction under a condition suitable for generating a plurality of immobilized double-stranded concatemers by conducting a temperature ramp-up condition, an amplification incubation condition, and a temperature ramp-down condition, wherein individual concatemers in the plurality of double-stranded nucleic acid concatemers have two or more tandem copies of repeat units which include the of the sequence of interest (or complementary sequence thereof) and any adaptor sequences (or complementary sequence thereof) present in the immobilized single stranded concatemer template molecules; (5) washing the immobilized double-stranded concatemers to removes the strand-displacing polymerase under condition suitable to retain the immobilized double-stranded concatemers; and (6) repeating steps (2)-(5) at least once (e.g., at least one cycle).

In some embodiments, the relaxant reaction mixture of step (2) can be formed with at least one nucleic acid relaxing agent that can disrupt hydrogen bonding in the immobilized nucleic acid concatemers. Exemplary relaxing agents include nucleic acid denaturants, chaotropic compounds, amide compounds, aprotic compounds, primary alcohols and ethylene glycol derivatives. Chaotropic compounds comprise urea, guanidine hydrochloride or guanidine thiocyanate. Amide compounds comprise formamide, acetamide or NN-dimethylformamide (DMF). Aprotic compounds comprise acetonitrile, DMSO (dimethyl sulfoxide), 1,4-dioxane or tetrahydrofuran. Primary alcohols comprise 1-propanol, ethanol or methanol. Ethylene glycol derivatives comprise 1,3-propanediol, ethylene glycol, glycerol, 1,2-dimethyoxyethane or 2-methoxyethanol. Other relaxing agents include sodium iodide, potassium iodide and polyamines In some embodiments, the relaxant reaction mixture of step (2) comprises any one or a combination of two or more of a group selected from urea, guanidine hydrochloride, guanidine thiocyanate, formamide, acetamide, NN-dimethylformamide (DMF), acetonitrile, DMSO (dimethyl sulfoxide), 1,4-dioxane, tetrahydrofuran, 1-propanol, ethanol, methanol, 1,3-propanediol, ethylene glycol, glycerol, 1,2-dimethyoxyethane, 2-methoxyethanol, sodium iodide, potassium iodide and/or polyamines.

In some embodiments, the relaxant reaction mixture of step (2) comprises formamide and SSC. In some embodiments, the relaxant reaction mixture comprises acetonitrile, formamide and SSC. In some embodiments, the relaxant reaction mixture comprises acetonitrile, formamide and MES (2-(4-morpholino)-ethane sulfonic acid). In some embodiments, the relaxant reaction mixture comprises acetonitrile, formamide, guanidium hydrochloride and HEPES (4-(2-hydroxyethyl)-1-piperazineethanesulfonic acid). In some embodiments, the relaxant reaction mixture comprises acetonitrile, formamide, urea and HEPES. In some embodiments, the SSC in the relaxant reaction mixture can be 1×, 2×, 3× or 4×.

In some embodiments, in the forming the relaxant reaction mixture of step (2), the temperature ramp-up condition can be conducted from about 20° C. to about 70° C., the relaxant incubation condition can be conducted at a temperature of about 40-70° C., and the temperature ramp-down condition can be conducted from about 70° C. to about 20° C. A skilled artisan will recognize that the temperature ramp-up, relaxant incubation temperature, and temperature ramp-down conditions can be modified.

In some embodiments, in the flexing amplification reaction mixture of step (3), the second plurality of polymerases having strand displacement activity comprises large fragment of Bst DNA polymerase (e.g., exonuclease minus), phi29 DNA polymerase, large fragment of Bsu DNA polymerase, and Bca (exo-) DNA polymerase, Klenow fragment of *E. coli* DNA polymerase, T5 polymerase, M-MuLV reverse transcriptase, HIV viral reverse transcriptase, or Deep Vent® DNA polymerase. The phi29 DNA polymerase can be wild type phi29 DNA polymerase (e.g., MagniPhi™ from Expedeon), or variant EquiPhi29™ DNA polymerase (e.g., from Thermo Fisher Scientific), or chimeric QualiPhi™ DNA polymerase (e.g., from 4basebio).

In some embodiments, in the flexing amplification reaction mixture of step (3), the concentration (e.g., total concentration) of the third plurality of nucleotides can promote a nucleotide polymerization reaction. For example, the concentration (e.g., total concentration) of the third plurality of nucleotides is about 0.1-10 mM.

In some embodiments, the plurality of nucleotides in the flexing amplification reaction mixture of step (3) comprise a mixture of nucleotide comprising dATP, dGTP, dCTP, and optionally a nucleotide analog having a scissile moiety. In some embodiments, the nucleotide having the scissile moiety comprises uridine, 8-oxo-7,8-dihydroguanine (e.g., 8oxoG) or deoxyinosine.

In some embodiments, in the flexing amplification reaction mixture of step (3), the at least one divalent cation that mediates nucleotide binding and mediates nucleotide polymerization comprises a catalytic divalent cation. In some embodiments, the catalytic divalent cation comprises magnesium and/or manganese. The concentration of the catalytic divalent cation in the amplification reaction mixture can be about 1-20 mM.

In some embodiments, the flexing amplification reaction mixture of step (3) can include at least one accessory protein or enzyme, including helicase, single-stranded binding (SSB) protein, or recombinase (e.g., T4 uvsX) and/or recombinase accessory factor (e.g., T4 uvsY or T4 gp32). In some embodiments, these accessory proteins can be omitted.

In some embodiments, in the flexing amplification reaction of step (4), the temperature ramp-up condition can be conducted from about 20° C. to about 90° C.

In some embodiments, in the flexing amplification reaction of step (4), the temperature ramp-up condition can be conducted for about 5-15 seconds, or about 15-30 seconds, or about 30-45 seconds, or about 45-60 seconds, or longer.

In some embodiments, in the flexing amplification reaction of step (4), the amplification incubation condition can be about 50, 51, 52, 53, 54, 55, 56, 57, 58, 59, 60, 61, 62, 63, 64, 65, 66, 67, 68, 69 or 70° C., or at a higher temperature.

In some embodiments, in the flexing amplification reaction of step (4), the amplification incubation condition can be conducted for about 30-45 seconds, or about 45-60 seconds, or about 60-75 seconds, or about 75-90 seconds, or longer.

In some embodiments, in the flexing amplification reaction of step (4), the temperature ramp-down condition can be conducted from about 90° C. to about 20° C.

In some embodiments, in the flexing amplification reaction of step (4), the temperature ramp-down condition can be conducted for about 5-15 seconds, or about 15-30 seconds, or about 30-45 seconds, or about 45-60 seconds, or longer.

In some embodiments, in the washing of step (5), the wash buffer comprises 1×SSC, or 1×SSC with cobalt hexamine.

In some embodiments, steps (2)-(5) can be repeated at least once, or repeated up to 10 times, or repeated up to 15 times, or repeated up to 20 times, or repeated up to 30 times or more.

Sequencing Methods

The present disclosure provides methods for conducting pairwise sequencing that employs a sequencing polymerase and labeled or non-labeled chain terminating nucleotides, where the chain terminating nucleotides include a 3'-O-azido group (or 3'-O-methylazido group) or any other type of bulky blocking group at the sugar 3' position. For example, sequencing-by-synthesis (SBS) methods employ labeled chain-terminating nucleotides, and sequencing-by-binding methods (SBB) employ non-labeled chain-terminating nucleotides.

The present disclosure also provides methods for conducting pairwise sequencing using sequencing-by-avidity methods (SBA) that employs a sequencing polymerase and labeled multivalent molecules and non-labeled chain terminating nucleotides.

Sequencing-by-avidity (SBA) of a template molecule (e.g., DNA template molecule) ideally requires (a) the detection of the n+1 base and requires 2 or more copies of target nucleic acid sequence, two or more primer nucleic acid molecules that are complementary to one or more regions of said target nucleic acid sequence and two more polymerases contacting said composition with a multivalent molecule (e.g., a polymer-nucleotide conjugate) under conditions sufficient to allow a multivalent binding complex to be formed between said polymer-nucleotide conjugate and said two or more copies of said target nucleic acid sequence in said composition of wherein the polymer-nucleotide conjugate comprises two or more nucleotide moieties; the detection substrates is subsequently washed away and (b) to ensure only a single incorporation occurs, a structural modification ('blocking group') of the an unlabeled nucleotides is required to ensure a single nucleotide incorporation but which then prevents any further nucleotide incorporation into the polynucleotide chain. The blocking group must then be removable, under reaction conditions which do not interfere with the integrity of the DNA being sequenced. The sequencing cycle can then continue with the N+1 detection of the next multivalent polymerase-conjugate-DNA complex and so on. In order to be of practical use, the avidity step requires both (a) a stable substrate to persist for long enough to image for >30 s and (b) a stepping step whereby the entire process should consist of high yielding, highly specific chemical and enzymatic steps to facilitate multiple cycles of sequencing.

Sequencing-by-synthesis (SBS) of a template molecule (e.g., DNA template molecule) ideally requires the controlled (i.e. one at a time) incorporation of the correct complementary nucleotide opposite the oligonucleotide being sequenced. This allows for accurate sequencing by adding nucleotides in multiple cycles as each nucleotide residue is sequenced one at a time, thus preventing an uncontrolled series of incorporations occurring. The incorporated nucleotide is read using an appropriate label attached thereto before removal of the label moiety and the subsequent next round of sequencing. In order to ensure only a single incorporation occurs, a structural modification ('blocking group') of the sequencing nucleotides is required to ensure a single nucleotide incorporation but which then prevents any further nucleotide incorporation into the polynucleotide chain. The blocking group must then be removable, under reaction conditions which do not interfere with the integrity of the DNA being sequenced. The sequencing cycle can then continue with the incorporation of the next blocked, labelled nucleotide. In order to be of practical use, the entire process should consist of high yielding, highly specific chemical and enzymatic steps to facilitate multiple cycles of sequencing.

Sequencing-by-binding (SBB) a template molecule (e.g., DNA template molecule) requires method for sequencing a nucleic acid that includes the steps of (a) sequentially contacting a primed template nucleic acid with at least two separate mixtures under ternary complex stabilizing conditions, wherein the at least two separate mixtures each include a polymerase and a nucleotide, whereby the sequentially contacting results in the primed template nucleic acid being contacted, under the ternary complex stabilizing conditions, with nucleotide cognates for first, second and third base type base types in the template; (b) examining the at least two separate mixtures to determine whether a ternary complex formed; and (c) identifying the next correct nucleotide for the primed template nucleic acid molecule, wherein the next correct nucleotide is identified as a cognate of the first, second or third base type if ternary complex is detected in step (b), and wherein the next correct nucleotide is imputed to be a nucleotide cognate of a fourth base type based on the absence of a ternary complex in step (b); (d) adding a next correct nucleotide to the primer of the primed template nucleic acid after step (b), thereby producing an extended primer; and (e) repeating steps (a) through (d) for the primed template nucleic acid that comprises the extended primer.

Methods for Sequencing with Nucleotides

The present disclosure provides pairwise sequencing compositions and methods which employ methods for sequencing the plurality of immobilized concatemer template molecules and methods for sequencing the plurality of retained forward extension strands. The sequencing methods comprise: (a) contacting a plurality of sequencing polymerases to (i) a plurality of nucleic acid template molecules (e.g., a plurality of immobilized concatemer template molecules or a plurality of the retained forward extension strands) and (ii) a plurality of nucleic acid sequencing primers (e.g., a plurality of the soluble forward sequencing primer or a plurality of the soluble reverse sequencing primers), wherein the contacting is conducted under a condition suitable to form a plurality of complexed polymerases each comprising a sequencing polymerase bound to a nucleic acid duplex wherein the nucleic acid duplex comprises a nucleic acid template molecule hybridized to a nucleic acid sequencing primer. In some embodiments, the plurality of sequencing primers comprise 3' OH extendible ends. In some embodiments, the soluble sequencing primers lack a nucleotide having a scissile moiety which comprises uridine, 8-oxo-7,8-dihydrogunine, or deoxyinosine. In some embodiments, the plurality of sequencing polymerases comprise recombinant sequencing polymerases. In some embodiments, the plurality of sequencing polymerases comprise exonuclease-minus sequencing polymerases.

In some embodiments, the sequencing method further comprises contacting the (b) contacting the plurality of complexed sequencing polymerase with a plurality of nucleotides under a condition suitable for binding at least one nucleotide to a complexed sequencing polymerase. In some embodiments, the complexed sequencing polymerase are contacted with the plurality of nucleotides in the presence of at least one catalytic cation that promotes polymerase-catalyzed nucleotide incorporation, where the catalytic cation comprises magnesium and/or manganese. In some embodiments, the plurality of nucleotides comprises at least one nucleotide analog having a chain terminating moiety at the sugar 2' or 3' position, where the chain terminating moiety is removable or is not removable. In some embodiments, the plurality of nucleotides comprises at least one nucleotide that lacks a chain terminating moiety. In some embodiments, the plurality of nucleotides comprises a plurality of nucleotides labeled with detectable reporter moiety. In some embodiments, the detectable reporter moiety comprises a fluorophore. In some embodiments, the fluorophore is attached to the nucleotide base. In some embodiments, the fluorophore is attached to the nucleotide base with a linker which is cleavable/removable from the base or is not removable from the base. In some embodiments, at least one of the nucleotides in the plurality is not labeled with a detectable reporter moiety. In some embodiments, a particular detectable reporter moiety (e.g., fluorophore) that is attached to the nucleotide can correspond to the nucleotide base (e.g., dATP, dGTP, dCTP, dTTP or dUTP) to permit detection and identification of the nucleotide base.

In some embodiments, the sequencing method further comprises (c) incorporating at least one nucleotide into the 3' end of the extendible primer. In some embodiments, the at least one nucleotide binds the complexed sequencing polymerase and incorporates into the 3' end of the extendible primer. In some embodiments, incorporation of the nucleotide into the 3' end of the primer in step (c) comprises a primer extension reaction.

In some embodiments, the sequencing method further comprises (d) detecting the incorporated nucleotide and identifying the nucleo-base of the incorporated nucleotide.

In some embodiments, the sequencing method further comprises (e) repeating steps (b), (c) and (d) at least once.

The present disclosure provides pairwise sequencing compositions and methods which employ methods for sequencing the plurality of immobilized concatemer template molecules. The sequencing methods comprise: (a) contacting a plurality of sequencing polymerases to (i) a plurality of immobilized concatemer template molecules and (ii) a plurality of the soluble forward sequencing primers, wherein the contacting is conducted under a condition suitable to form a plurality of complexed polymerases each comprising a sequencing polymerase bound to a nucleic acid duplex wherein the nucleic acid duplex comprises a immobilized concatemer template molecule hybridized to a soluble forward sequencing primer; (b) contacting the plurality of complexed sequencing polymerases with a plurality of nucleotides in the presence of at least one catalytic cation that promotes polymerase-catalyzed nucleotide incorporation (e.g., magnesium and/or manganese) and under a condition suitable for binding at least one nucleotide to a complexed sequencing polymerase, wherein the plurality of nucleotides comprises at least one nucleotide analog having a removable chain terminating moiety at the sugar 3' position and labeled with a fluorophore; (c) incorporating at least one nucleotide into the 3' end of the hybridized forward sequencing primers thereby generating a plurality of nascent extended forward sequencing primers; and (d) detecting the incorporated nucleotide and identifying the nucleo-base of the incorporated nucleotide. In some embodiments, the sequencing method further comprises: (e) removing the chain terminating moiety from the incorporated nucleotide to generate an extendible 3'OH group on the sugar moiety of the nucleotide while retaining the plurality of complexed polymerases each comprising a sequencing polymerase bound to a nucleic acid duplex wherein the nucleic acid duplex comprises a immobilized concatemer template molecule hybridized to a nascent extended forward sequencing primer; (g) contacting the retained complexed polymerases with a plurality of nucleotides in the presence of at least one catalytic cation that promotes polymerase-catalyzed nucleotide incorporation under a condition suitable for binding at least one nucleotide to a complexed sequencing polymerase, wherein the plurality of nucleotides comprises at least one nucleotide analog having a removable chain terminating moiety at the sugar 3' position and labeled with a fluorophore; (g) incorporating at least one nucleotide into the 3' end of the nascent extended forward sequencing primer; (h) detecting the incorporated nucleotide and identifying the nucleo-base of the incorporated nucleotide; and (i) repeating steps (e)-(g) at least once. In some embodiments, the removing of step (e) can be conducted using a cleaving reagent. The cleaving reagent can include or lacks one or more compounds that can reduce photo-damage, including antioxidants, triplet state quenchers, singlet oxygen quenchers, oxygen scavengers, electron scavengers, anti-fade formulations.

The present disclosure provides pairwise sequencing compositions and methods which employ methods for sequencing the plurality of retained forward extension strands. The sequencing methods comprise: (a) contacting a plurality of sequencing polymerases to (i) a plurality of the retained forward extension strands and (ii) a plurality of the soluble reverse sequencing primers, wherein the contacting is conducted under a condition suitable to form a plurality of complexed polymerases each comprising a sequencing polymerase bound to a nucleic acid duplex wherein the nucleic acid duplex comprises a retained forward extension strand hybridized to a soluble reverse sequencing primer; (b) contacting the plurality of complexed sequencing polymerases with a plurality of nucleotides in the presence of at least one catalytic cation that promotes polymerase-catalyzed nucleotide incorporation (e.g., magnesium and/or manganese) and under a condition suitable for binding at least one nucleotide to a complexed sequencing polymerase, wherein the plurality of nucleotides comprises at least one nucleotide analog having a removable chain terminating moiety at the sugar 3' position and labeled with a fluorophore; (c) incorporating at least one nucleotide into the 3' end of the hybridized reverse sequencing primers thereby generating a plurality of nascent extended reverse sequencing primers; and (d) detecting the incorporated nucleotide and identifying the nucleo-base of the incorporated nucleotide. In some embodiments, the sequencing method further comprises: (e) removing the chain terminating moiety from the incorporated nucleotide to generate an extendible 3'OH group on the sugar moiety of the nucleotide while retaining the plurality of complexed polymerases each comprising a sequencing polymerase bound to a nucleic acid duplex wherein the nucleic acid duplex comprises a retained forward extension strand hybridized to a nascent extended reverse sequencing primer; (f) contacting the retained complexed polymerases with a plurality of nucleotides in the presence of at least one catalytic cation that promotes polymerase-catalyzed nucleotide incorporation under a condition suitable for binding at least one nucleotide to a complexed sequencing polymerase, wherein the plurality of nucleotides comprises at least one nucleotide analog having a removable chain terminating moiety at the sugar 3' position and labeled with a fluorophore; (g) incorporating at least one nucleotide into the 3' end of the nascent extended reverse sequencing primer; (h) detecting the incorporated nucleotide and identifying the nucleo-base of the incorporated nucleotide; and (i) repeating steps (e)-(g) at least once. In some embodiments, the removing of step (e) can be conducted using a cleaving reagent. The cleaving reagent can include or lacks one or more compounds that can reduce photo-damage, including antioxidants, triplet state quenchers, singlet oxygen quenchers, oxygen scavengers, electron scavengers, anti-fade formulations.

Methods for Sequencing with Multivalent Molecules and Nucleotides

The present disclosure provides pairwise sequencing compositions and methods which employ methods for sequencing the plurality of immobilized concatemer template molecules (or a plurality of immobilized non-concatemer template molecules) and methods for sequencing the plurality of retained forward extension strands. The sequencing methods generally comprise the steps: (1) conducting a sequencing reaction at a position on the template molecule using multivalent molecules which bind but do not incorporate; and (2) conducting a sequencing reaction at the same position on the template molecule using nucleotides with incorporation; and (3) repeating steps (1) and (2) at the next position on the template molecule. The nucleotide incorporation of step (2) generates an extended forward sequencing primer strand or an extended reverse sequencing primer strand. The repeating of steps (1) and (2) generates an extended forward sequencing primer strand or an extended reverse sequencing primer strand.

The sequencing methods comprise: (a) contacting a plurality of a first sequencing polymerase to (i) a plurality of nucleic acid template molecules (e.g., a plurality of the immobilized concatemer template molecules or a plurality of the retained forward extension strands) and (ii) a plurality of soluble nucleic acid sequencing primers (e.g., a plurality of the soluble forward sequencing primer or a plurality of the soluble reverse sequencing primer), wherein the contacting is conducted under a condition suitable to form a plurality of first complexed polymerases each comprising a first sequencing polymerase bound to a nucleic acid duplex wherein the nucleic acid duplex comprises the nucleic acid template molecule hybridized to the soluble nucleic acid sequencing primer. In some embodiments, the plurality of sequencing primers comprise 3' OH extendible ends. In some embodiments, the plurality of nucleic acid template molecules comprise a plurality of the immobilized concatemer template molecules and the plurality of nucleic acid sequencing primers comprise a plurality of the soluble forward sequencing primers. In some embodiments, the plurality of nucleic acid template molecules comprise a plurality of the retained forward extension strands and the plurality of nucleic acid sequencing primers comprise a plurality of the soluble reverse sequencing primers. In an alternative embodiment, the first and second template molecules are clonally amplified non-concatemer template molecules that are localized in close proximity to each other. For example, the clonally-amplified first and second template molecules comprise linear template molecules that are generated via bridge amplification and are immobilized to the same location or feature on a support. The first and second non-concatemer template molecules comprise a sequence of interest and at least one universal sequencing primer binding site. The first and second soluble sequencing primers can bind to a sequencing primer binding site on the first and second non-concatemer template molecules, respectively.

In some embodiments, the sequencing methods further comprise step (b): contacting the plurality of first complexed polymerases with a plurality of multivalent molecules to form a plurality of multivalent-complexed polymerases. In some embodiments, individual multivalent molecules in the plurality of multivalent molecules comprise a core attached to multiple nucleotide arms and each nucleotide arm is attached to a nucleotide (e.g., nucleotide unit) (see FIGS. 104-114). In some embodiments, the contacting of step (b) is conducted with a mixture of any combination of two or more types of multivalent molecules, where individual multivalent molecules in the mixture comprise nucleotide units selected from a group consisting of dATP, dGTP, dCTP, dTTP and/or dUTP. In some embodiments, the contacting of step (b) is conducted under a condition suitable for binding complementary nucleotide units of the multivalent molecules to at least two of the plurality of first complexed polymerases thereby forming a plurality of multivalent-complexed polymerases. The nucleotide unit of a multivalent molecule can bind the 3' end of a sequencing primer (or the 3' end of a nascent extended sequencing primer) at a position that is opposite a complementary nucleotide in the template molecule. In some embodiments, the condition is suitable for inhibiting incorporation of the complementary nucleotide units into the sequencing primers (or into the nascent extended sequence primer) of the plurality of multivalent-complexed polymerases. In some embodiments, the contacting of step (b) is conducted in the presence of a non-catalytic divalent cation that permits binding of the nucleotide unit to the complexed polymerase but inhibits polymerase-catalyzed incorporation of the nucleotide unit into the sequencing primer (or into the nascent extended sequencing primer) of the complexed polymerase, where the non-catalytic divalent cation comprises strontium and/or barium. In some embodiments, the plurality of multivalent molecules comprise at least one multivalent molecule having multiple nucleotide arms each attached with a nucleotide analog (e.g., nucleotide analog unit), where the nucleotide analog includes a removable chain terminating moiety at the sugar 2' and/or 3' position. In some embodiments, the plurality of multivalent molecules comprises at least one multivalent molecule comprising multiple nucleotide arms each attached with a nucleotide unit that lacks a chain terminating moiety. In some embodiments, at least one of the multivalent molecules in the plurality of multivalent molecules is labeled with a detectable reporter moiety. In individual multivalent molecules, at least one detectable moiety is attached to the core, or a detectable moiety is attached to at least one nucleotide unit, or a detectable moiety is attached to at least one linker. In some embodiments, the detectable reporter moiety comprises a fluorophore.

In some embodiments, the sequencing methods further comprise step (c): detecting the plurality of multivalent-complexed polymerases. In some embodiments, the detecting includes detecting the multivalent molecules that are bound to the complexed polymerases, where the complementary nucleotide units of the multivalent molecules are bound to the sequencing primers but incorporation of the complementary nucleotide units is inhibited. In some embodiments, the multivalent molecules are labeled with a detectable reporter moiety to permit detection. In some embodiments, the core is labeled with a detectable reporter moiety. In some embodiments, at least one linker and/or at least one nucleotide unit of a nucleotide arm is labeled with a detectable reporter moiety.

In some embodiments, the sequencing methods further comprise step (d): identifying the nucleo-base of the complementary nucleotide units that are bound to the plurality of first complexed polymerases (in the plurality of multivalent-complexes polymerases), thereby determining the sequence of the nucleic acid template. In some embodiments, the multivalent molecules are labeled with a detectable reporter moiety that corresponds to the particular nucleotide units attached to the nucleotide arms to permit identification of the complementary nucleotide units (e.g., nucleotide base adenine, guanine, cytosine, thymine or uracil) that are bound to the plurality of first complexed polymerases. In some embodiments, a given multivalent molecule is labeled with a known fluorophore to permit differentiation and identification of the nucleo-bases of the given multivalent molecule.

In some embodiments, in the sequencing methods, the binding of the plurality of first complexed polymerases with the plurality of multivalent molecules forms at least one avidity complex, the method comprising the steps: (1) binding a first soluble sequencing primer (e.g., a soluble forward sequencing primer or a soluble reverse sequencing primer), a first sequencing polymerase, and a first multivalent molecule to a first portion of a nucleic acid concatemer template molecule (e.g., an immobilized concatemer template molecule or a retained forward extension strand) thereby forming a first binding complex (e.g., a first multivalent-complexed polymerase), wherein a first nucleotide unit of the first multivalent molecule binds to the first sequencing polymerase; and (2) binding a second soluble sequencing primer (e.g., a soluble forward sequencing primer or a soluble reverse sequencing primer), a second sequencing polymerase, and the first multivalent molecule to a second portion of the same nucleic acid concatemer template molecule thereby forming a second binding complex (e.g., a second multivalent-complexed polymerase), wherein a second nucleotide unit of the second multivalent molecule binds to the second sequencing polymerase, wherein the first and second binding complexes which include the same multivalent molecule forms an avidity complex.

In some embodiments, the first sequencing primer comprises a soluble forward sequencing primer and the nucleic acid template molecule comprises an immobilized concatemer template molecule. In some embodiments, the second sequencing primer comprises a soluble forward sequencing primer and the nucleic acid template molecule comprises the same immobilized concatemer template molecule. The first and second sequencing primers have the same sequence.

In some embodiments, the first sequencing primer comprises a soluble reverse sequencing primer and the nucleic acid template molecule comprises a retained forward extension strand. In some embodiments, the second sequencing primer comprises a soluble reverse sequencing primer and the nucleic acid template molecule comprises the same retained forward extension strand. The first and second sequencing primers have the same sequence.

In some embodiments, the first sequencing polymerase comprises any wild type or mutant polymerase described herein. In some embodiments, the second sequencing polymerase comprises any wild type or mutant polymerase described herein. The concatemer template molecule comprises tandem repeat sequences of a sequence of interest and at least one universal sequencing primer binding site. The first and second soluble sequencing primers can bind to a sequencing primer binding site along the concatemer template molecule.

In some embodiments, the sequencing methods include binding the plurality of first complexed polymerases with the plurality of multivalent molecules to form at least one avidity complex, the method comprising the steps: (1) contacting a plurality of first sequencing polymerases and a plurality of second sequencing primers with different portions of a nucleic acid concatemer template molecule (e.g., an immobilized concatemer template molecule or a retained forward extension strand) to form at least first and second complexed polymerases on the same nucleic acid concatemer template molecule; (2) contacting a plurality of multivalent molecules to the at least first and second complexed polymerases on the same nucleic acid concatemer template molecule, under conditions suitable to bind a single multivalent molecule from the plurality to the first and second complexed polymerases, wherein at least a first nucleotide unit of the single multivalent molecule is bound to the first complexed polymerase which includes a first sequencing primer hybridized to a first portion of the nucleic acid concatemer template molecule thereby forming a first binding complex (e.g., a first multivalent-complexed polymerase), and wherein at least a second nucleotide unit of the single multivalent molecule is bound to the second complexed polymerase which includes a second sequencing primer hybridized to a second portion of the same nucleic acid concatemer template molecule thereby forming a second binding complex (e.g., a second multivalent-complexed polymerase), wherein the contacting is conducted under a condition suitable to inhibit polymerase-catalyzed incorporation of the bound first and second nucleotide units in the first and second binding complexes, and wherein the first and second binding complexes which are bound to the same multivalent molecule forms an avidity complex; (3) detecting the first and second binding complexes on the same nucleic acid concatemer template molecule, and (4) identifying the first nucleotide unit in the first binding complex thereby determining the sequence of the first portion of the nucleic acid template molecule, and identifying the second nucleotide unit in the second binding complex thereby determining the sequence of the second portion of the same nucleic acid template molecule.

In some embodiments, the plurality of DNA polymerases comprise any wild type or mutant polymerase described herein. The concatemer template molecule comprises tandem repeat sequences of a sequence of interest and at least one universal sequencing primer binding site. The plurality of first and second sequencing primers can bind to a sequencing primer binding site along the concatemer template molecule.

In some embodiments, the plurality of first sequencing primers comprise a plurality of first soluble forward sequencing primers and the nucleic acid concatemer template molecule comprises an immobilized concatemer template molecule. In some embodiments, the plurality of second sequencing primers comprise a plurality of second soluble forward sequencing primers and the nucleic acid template molecule comprises the same immobilized concatemer template molecule. The plurality of first and second sequencing primers have the same sequence.

In some embodiments, the plurality of first sequencing primers comprise a plurality of first soluble reverse sequencing primer and the nucleic acid template molecule comprises a retained forward extension strand. In some embodiments, the plurality of second sequencing primers comprise a plurality of second soluble reverse sequencing primer and the nucleic acid template molecule comprises the same retained forward extension strand. The plurality of first and second sequencing primers have the same sequence.

In some embodiments, in the sequencing methods, the binding of the plurality of first complexed polymerases with the plurality of multivalent molecules forms at least one avidity complex, the method comprising the steps: (1) binding a first soluble sequencing primer (e.g., a soluble forward sequencing primer or a soluble reverse sequencing primer), a first sequencing polymerase, and a first multivalent molecule to a first template molecule (e.g., an immobilized template molecule or a retained forward extension strand) thereby forming a first binding complex (e.g., a first multivalent-complexed polymerase), wherein a first nucleotide unit of the first multivalent molecule binds to the first sequencing polymerase; and (2) binding a second soluble sequencing primer (e.g., a soluble forward sequencing primer or a soluble reverse sequencing primer), a second sequencing polymerase, and the first multivalent molecule to a second template molecule thereby forming a second binding complex (e.g., a second multivalent-complexed polymerase), wherein a second nucleotide unit of the second multivalent molecule binds to the second sequencing polymerase, wherein the first and second binding complexes which include the same multivalent molecule forms an avidity complex.

In some embodiments, the first sequencing polymerase comprises any wild type or mutant polymerase described herein. In some embodiments, the second sequencing polymerase comprises any wild type or mutant polymerase described herein. In some embodiments, the first and second template molecules are clonally amplified template molecules. In some embodiments, the first and second template molecules are localized in close proximity to each other. For example, the clonally-amplified first and second template molecules comprise linear template molecules that are generated via bridge amplification and are immobilized to the same location or feature on a support. The first and second template molecules comprise a sequence of interest and at least one universal sequencing primer binding site. The first and second soluble sequencing primers can bind to a sequencing primer binding site on the first and second template molecules, respectively.

In some embodiments, the first soluble sequencing primer comprises a soluble forward sequencing primer and the first template molecule comprises an immobilized first template molecule. In some embodiments, the second soluble sequencing primer comprises a soluble forward sequencing primer and the first template molecule comprises the same immobilized first template molecule. The first and second soluble sequencing primers have the same sequence.

In some embodiments, the first soluble sequencing primer comprises a soluble reverse sequencing primer and the first template molecule comprises a retained forward extension strand. In some embodiments, the second soluble sequencing primer comprises a soluble reverse sequencing primer and the second template molecule comprises the same retained forward extension strand. The first and second soluble sequencing primers have the same sequence.

In some embodiments, the sequencing methods include binding the plurality of first complexed polymerases with the plurality of multivalent molecules to form at least one avidity complex, the method comprising the steps: (1) contacting a plurality of sequencing polymerases and a plurality of soluble sequencing primers (which includes first and second soluble sequencing primers) with a first and second template molecule, respectively (e.g., immobilized first or second template molecules, or retained first or second forward extension strands) to form at least first and second complexed polymerases on the first and second template molecules, respectively; (2) contacting a plurality of multivalent molecules to the at least first and second complexed polymerases, under conditions suitable to bind a single multivalent molecule from the plurality to the first and second complexed polymerases, wherein at least a first nucleotide unit of the single multivalent molecule is bound to the first complexed polymerase which includes a first sequencing primer hybridized to the first template molecule thereby forming a first binding complex (e.g., a first multivalent-complexed polymerase), and wherein at least a second nucleotide unit of the single multivalent molecule is bound to the second complexed polymerase which includes a second sequencing primer hybridized to the second template molecule thereby forming a second binding complex (e.g., a second multivalent-complexed polymerase), wherein the contacting is conducted under a condition suitable to inhibit polymerase-catalyzed incorporation of the bound first and second nucleotide units in the first and second binding complexes, and wherein the first and second binding complexes which are bound to the same multivalent molecule forms an avidity complex; (3) detecting the first and second binding complexes on the first and second template molecules, and (4) identifying the first nucleotide unit in the first binding complex thereby determining the sequence of the first template molecule, and identifying the second nucleotide unit in the second binding complex thereby determining the sequence of the second template molecule.

In some embodiments, the plurality of DNA polymerases comprise any wild type or mutant polymerase described herein. The first and second template molecules are clonally amplified template molecules. In some embodiments, the first and second template molecules are localized in close proximity to each other. For example, the clonally-amplified first and second template molecules comprise linear template molecules that are generated via bridge amplification and are immobilized to the same location or feature on a support. The first and second template molecules comprise a sequence of interest and at least one universal sequencing primer binding site. The first and second soluble primers can bind to a sequencing primer binding site on the first and second template molecules, respectively.

In some embodiments, the plurality of first sequencing primers comprise a plurality of first soluble forward sequencing primers and the first template molecule comprises an immobilized first template molecule. In some embodiments, the plurality of second sequencing primers comprise a plurality of second soluble forward sequencing primers and the second template molecule comprises an immobilized second template molecule. The plurality of first and second sequencing primers have the same sequence.

In some embodiments, the plurality of first sequencing primers comprise a plurality of first soluble reverse sequencing primer and the first template molecule comprises a first retained forward extension strand. In some embodiments, the plurality of second sequencing primers comprise a plurality of second soluble reverse sequencing primer and the second template molecule comprises a second retained forward extension strand. The plurality of first and second sequencing primers have the same sequence.

In some embodiments, the sequencing methods further comprise step (e): dissociating the plurality of multivalent-complexed polymerases and removing the plurality of first sequencing polymerases and their bound multivalent molecules, and retaining the plurality of nucleic acid duplexes.

In some embodiments, the sequencing methods further comprise step (f): contacting the plurality of the retained nucleic acid duplexes of step (e) with a plurality of second sequencing polymerases, wherein the contacting is conducted under a condition suitable for binding the plurality of second sequencing polymerases to the plurality of the retained nucleic acid duplexes, thereby forming a plurality of second complexed polymerases each comprising a second sequencing polymerase bound to a retained nucleic acid duplex.

In some embodiments, the plurality of first sequencing polymerases of step (a) have an amino acid sequence that is 100% identical to the amino acid sequence as the plurality of the second sequencing polymerases of step (f). In some embodiments, the plurality of first sequencing polymerases of step (a) have an amino acid sequence that differs from the amino acid sequence of the plurality of the second sequencing polymerases of step (f).

In some embodiments, the sequencing methods further comprise step (g): contacting the plurality of second complexed polymerases with a plurality of nucleotides (e.g., free nucleotides), wherein the contacting is conducted under a condition suitable for binding complementary nucleotides from the plurality of nucleotides to at least two of the second complexed polymerases of step (f) thereby forming a plurality of nucleotide-complexed polymerases. In some embodiments, the contacting of step (g) is conducted under a condition that is suitable for promoting incorporation of the bound complementary nucleotides into the sequencing primers (or the nascent extended sequencing primers) of the nucleotide-complexed polymerases thereby forming a plurality of nucleotide-complexed polymerases. In some embodiments, incorporating the nucleotide into the 3' end of the primer in step (g) comprises a primer extension reaction. In some embodiments, the contacting of step (g) is conducted in the presence of a catalytic divalent cation that promotes polymerase-catalyzed nucleotide incorporation. In some embodiments, the catalytic divalent cation comprises magnesium and/or manganese. In some embodiments, the plurality of nucleotides comprise native nucleotides (e.g., non-analog nucleotides) or nucleotide analogs. In some embodiments, the plurality of nucleotides comprise a 2' and/or 3' chain terminating moiety which is removable or is not removable. In some embodiments, the plurality of nucleotides comprises a plurality of nucleotides labeled with detectable reporter moiety. In some embodiments, the detectable reporter moiety comprises a fluorophore. In some embodiments, the fluorophore is attached to the nucleotide base. In some embodiments, the fluorophore is attached to the nucleotide base with a linker which is cleavable/removable from the base or is not removable from the base. In some embodiments, at least one of the nucleotides in the plurality is not labeled with a detectable reporter moiety. In some embodiments, a particular detectable reporter moiety (e.g., fluorophore) that is attached to the nucleotide can correspond to the nucleotide base (e.g., dATP, dGTP, dCTP, dTTP or dUTP) to permit detection and identification of the nucleotide base.

In some embodiments, the sequencing methods further comprise step (h): detecting the complementary nucleotides which are incorporated into the sequencing primers (or the nascent extended sequencing primers) of the nucleotide-complexed polymerases. In some embodiments, the plurality of nucleotides are labeled with a detectable reporter moiety to permit detection. In some embodiments, the detecting step (h) is omitted.

In some embodiments, the sequencing methods further comprise step (i): identifying the nucleo-bases of the complementary nucleotides which are incorporated into the sequencing primers (or the nascent extended sequencing primers) of the nucleotide-complexed polymerases. In some embodiments, the identification of the incorporated complementary nucleotides in step (i) can be used to confirm the identity of the complementary nucleotide units of the multivalent molecules that were bound to the plurality of first complexed polymerases in step (d). In some embodiments, the identifying of step (i) can be used to determine the sequence of the nucleic acid template molecules. In some embodiments, the identifying step (i) is omitted.

In some embodiments, the sequencing methods further comprises step (i): removing the chain terminating moiety from the incorporated nucleotide when step (g) is conducted by contacting the plurality of second complexed polymerases with a plurality of nucleotides that comprise at least one nucleotide having a 2' and/or 3' chain terminating moiety. In some embodiments, the removing of step (j) can be conducted using a cleaving reagent. The cleaving reagent can include or lacks one or more compounds that can reduce photo-damage, including antioxidants, triplet state quenchers, singlet oxygen quenchers, oxygen scavengers, electron scavengers, anti-fade formulations.

In some embodiments, the sequencing methods further comprise step (k): repeating steps (a)-(j) at least once, by using the same nucleic acid sequencing primers of step (a). In some embodiments, the sequence of the nucleic acid template molecules can be determined by detecting and identifying the multivalent molecules that bind the sequencing polymerases but do not incorporate into the 3' end of the primer at steps (c) and (d). In some embodiments, the sequence of the nucleic acid template molecule can be determined (or confirmed) by detecting and identifying the nucleotide that incorporates into the 3' end of the primer at steps (h) and (i).

In an alternative sequencing method, the steps for forming a plurality of complexed polymerases further comprise step (b2): contacting the plurality of complexed polymerases of step (a) with a plurality of nucleotides under a condition suitable for binding a complementary nucleotide from the plurality of nucleotides to a complexed polymerase from the plurality of complexed polymerases thereby forming a nucleotide-complexed polymerase. In some embodiments, the contacting of step (b2) is conducted under a condition that is suitable for promoting nucleotide binding but inhibiting incorporation of the bound complementary nucleotides to the 3' end of the primers of the nucleotide-complexed polymerases. In some embodiments, the contacting of step (b2) is conducted in the presence of at least one cation selected from a group consisting of strontium, barium, sodium, magnesium, potassium, manganese, calcium, lithium, nickel and cobalt. The plurality of complexed polymerases can be contacted sequentially with at least two separate mixtures where each mixture comprises an engineered polymerase and a nucleotide. The contacting is conducted under conditions suitable for forming stable ternary complexes with cognates for first, second and third base type base types in the template. The method further comprises step (c3) examining the at least two separate mixtures to determine if a ternary complex formed. The method further comprises step (d3) identifying the next correct nucleotide for the primed template nucleic acid molecule, wherein the next correct nucleotide is identified as a cognate of the first, second or third base type if ternary complex is detected in step (c3), and wherein the next correct nucleotide is imputed to be a nucleotide cognate of a fourth base type based on the absence of a ternary complex in step (c3). The method further comprises step (e3) adding a next correct nucleotide to the primer of the primed template nucleic acid after step (c3), thereby producing an extended primer; and step (f3) repeating steps (a) through (e3) for the primed template nucleic acid that comprises the extended primer.

Nucleotides

In some embodiments, in any of the sequencing methods described herein, at least one nucleotide in the plurality of nucleotides comprise a base, sugar and at least one phosphate group. In some embodiments, at least one nucleotide in the plurality comprises an aromatic base, a five carbon sugar (e.g., ribose or deoxyribose), and one or more phosphate groups (e.g., 1-10 phosphate groups). The plurality of nucleotides can comprise at least one type of nucleotide selected from a group consisting of dATP, dGTP, dCTP, dTTP and dUTP. The plurality of nucleotides can comprise at a mixture of any combination of two or more types of nucleotides selected from a group consisting of dATP, dGTP, dCTP, dTTP and/or dUTP. In some embodiments, at least one nucleotide in the plurality is not a nucleotide analog. In some embodiments, at least one nucleotide in the plurality comprises a nucleotide analog.

In some embodiments, in any of the sequencing methods described herein, at least one nucleotide in the plurality of nucleotides comprise a chain of one, two or three phosphorus atoms where the chain is typically attached to the 5' carbon of the sugar moiety via an ester or phosphoramide linkage. In some embodiments, at least one nucleotide in the plurality is an analog having a phosphorus chain in which the phosphorus atoms are linked together with intervening O, S, NH, methylene or ethylene. In some embodiments, the phosphorus atoms in the chain include substituted side groups including O, S or $BH_3$. In some embodiments, the chain includes phosphate groups substituted with analogs including phosphoramidate, phosphorothioate, phosphordithioate, and O-methylphosphoroamidite groups.

In some embodiments, in any of the sequencing methods described herein, the plurality of nucleotides comprises a plurality of nucleotides labeled with detectable reporter moiety. The detectable reporter moiety comprises a fluorophore. In some embodiments, the fluorophore is attached to the nucleotide base. In some embodiments, the fluorophore is attached to the nucleotide base with a linker which is cleavable/removable from the base. In some embodiments, at least one of the nucleotides in the plurality is not labeled with a detectable reporter moiety. In some embodiments, a particular detectable reporter moiety (e.g., fluorophore) that is attached to the nucleotide can correspond to the nucleotide base (e.g., dATP, dGTP, dCTP, dTTP or dUTP) to permit detection and identification of the nucleotide base. In some embodiments, the method further comprises detecting the at least one incorporated nucleotide at step (c) and/or (d). In some embodiments, the method further comprises identifying the at least one incorporated nucleotide at step (c) and/or (d). In some embodiments, the sequence of the nucleic acid template molecule can be determined by detecting and identifying the nucleotide (nucleo-base) that binds the sequencing polymerase, thereby determining the sequence of the nucleic acid template. In some embodiments, the sequence of the nucleic acid template molecule can be determined by detecting and identifying the nucleotide (nucleo-base) that incorporates into the 3' end of the primer, thereby determining the sequence of the nucleic acid template. In some embodiments, detection and identification of the fluorescently-labeled nucleotides can be achieved by imaging the support upon which the sequencing reaction is conducted.

In some embodiments, in any of the sequencing methods described herein, at least one nucleotide in the plurality of nucleotides comprises a terminator nucleotide analog having a chain terminating moiety (e.g., blocking moiety) at the sugar 2' position, at the sugar 3' position, or at the sugar 2' and 3' position. In some embodiments, the chain terminating moiety can inhibit polymerase-catalyzed incorporation of a subsequent nucleotide unit or free nucleotide in a nascent strand during a primer extension reaction. In some embodiments, the chain terminating moiety is attached to the 3' sugar hydroxyl position where the sugar comprises a ribose or deoxyribose sugar moiety. In some embodiments, the chain terminating moiety is removable/cleavable from the 3' sugar hydroxyl position to generate a nucleotide having a 3'OH sugar group which is extendible with a subsequent nucleotide in a polymerase-catalyzed nucleotide incorporation reaction. In some embodiments, the chain terminating moiety comprises an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group. In some embodiments, the chain terminating moiety is cleavable/removable from the nucleotide, for example by reacting the chain terminating moiety with a chemical agent, pH change, light or heat. In some embodiments, the chain terminating moieties alkyl, alkenyl, alkynyl and allyl are cleavable with tetrakis(triphenylphosphine)palladium(0) ($Pd(PPh3)_4$) with piperidine, or with 2,3-Dichloro-5,6-dicyano-1,4-benzo-quinone (DDQ). In some embodiments, the chain terminating moieties aryl and benzyl are cleavable with H2 Pd/C. In some embodiments, the chain terminating moieties amine, amide, keto, isocyanate, phosphate, thio, disulfide are cleavable with phosphine or with a thiol group including beta-mercaptoethanol or dithiothritol (DTT). In some embodiments, the chain terminating moiety carbonate is cleavable with potassium carbonate ($K_2CO_3$) in MeOH, with triethylamine in pyridine, or with Zn in acetic acid (AcOH). In some embodiments, the chain terminating moieties urea and silyl are cleavable with tetrabutylammonium fluoride, pyridine-HF, with ammonium fluoride, or with triethylamine trihydrofluoride.

In some embodiments, in any of the sequencing methods described herein, at least one nucleotide in the plurality of nucleotides comprises a terminator nucleotide analog having a chain terminating moiety (e.g., blocking moiety) at the sugar 2' position, at the sugar 3' position, or at the sugar 2' and 3' position. In some embodiments, the chain terminating moiety comprises an azide, azido or azidomethyl group. In some embodiments, the chain terminating moiety comprises a 3'-O-azido or 3'-O-azidomethyl group. In some embodiments, the chain terminating moieties azide, azido and azidomethyl group are cleavable/removable with a phosphine compound. In some embodiments, the phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tris(hydroxyproyl)phosphine (THPP) or Tris(hydroxymethyl)phosphine (THMP). In some embodiments, the cleaving agent comprises 4-dimethylaminopyridine (4-DMAP).

In some embodiments, in any of the sequencing methods described herein, at least one nucleotide in the plurality of nucleotides comprises a terminator nucleotide analog having a chain terminating moiety (e.g., blocking moiety) at the sugar 2' and/or 3' position, where the incorporated chain terminating nucleotide is removed/cleaved by contacting the incorporated chain terminating nucleotide with a cleaving reagent. The cleaving reagent can include or lacks one or more compounds that can reduce photo-damage, including antioxidants, triplet state quenchers, singlet oxygen quenchers, oxygen scavengers, electron scavengers, anti-fade formulations.

In some embodiments, in any of the sequencing methods described herein, at least one nucleotide in the plurality of nucleotides comprises a chain terminating moiety which is selected from a group consisting of 3'-deoxy nucleotides, 2',3'-dideoxynucleotides, 3'-methyl, 3'-azido, 3'-azidomethyl, 3'-O-azidoalkyl, 3'-O-ethynyl, 3'-O-aminoalkyl, 3'-O-fluoroalkyl, 3'-fluoromethyl, 3'-difluoromethyl, 3'-trifluoromethyl, 3'-sulfonyl, 3'-malonyl, 3'-amino, 3'-O-amino, 3'-sulfhydral, 3'-aminomethyl, 3'-ethyl, 3'butyl, 3'-tert butyl, 3'-Fluorenylmethyloxycarbonyl, 3' tert-Butyloxycarbonyl, 3'-O-alkyl hydroxylamino group, 3'-phosphorothioate, and 3-O-benzyl, or derivatives thereof.

In some embodiments, in any of the sequencing methods described herein, at least one nucleotide in the plurality of nucleotides is labeled with detectable reporter moiety. The detectable reporter moiety comprises a fluorophore. In some embodiments, the fluorophore is attached to the nucleotide base. In some embodiments, the fluorophore is attached to the nucleotide base with a linker which is cleavable/removable from the base. In some embodiments, at least one of the nucleotides in the plurality is not labeled with a detectable reporter moiety. In some embodiments, a particular detectable reporter moiety (e.g., fluorophore) that is attached to the nucleotide can correspond to the nucleotide base (e.g., dATP, dGTP, dCTP, dTTP or dUTP) to permit detection and identification of the nucleotide base.

In some embodiments, in any of the sequencing methods described herein, the cleavable linker on the base comprises a cleavable moiety comprising an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group. In some embodiments, the cleavable linker on the base is cleavable/removable from the base by reacting the cleavable moiety with a chemical agent, pH change, light or heat. In some embodiments, the cleavable moieties alkyl, alkenyl, alkynyl and allyl are cleavable with tetrakis(triphenylphosphine)palladium(0) (Pd(PPh$_3$)$_4$) with piperidine, or with 2,3-Dichloro-5,6-dicyano-1,4-benzo-quinone (DDQ). In some embodiments, the cleavable moieties aryl and benzyl are cleavable with H2 Pd/C. In some embodiments, the cleavable moieties amine, amide, keto, isocyanate, phosphate, thio, disulfide are cleavable with phosphine or with a thiol group including beta-mercaptoethanol or dithiothritol (DTT). In some embodiments, the cleavable moiety carbonate is cleavable with potassium carbonate (K$_2$CO$_3$) in MeOH, with triethylamine in pyridine, or with Zn in acetic acid (AcOH). In some embodiments, the cleavable moieties urea and silyl are cleavable with tetrabutylammonium fluoride, pyridine-HF, with ammonium fluoride, or with triethylamine trihydrofluoride.

In some embodiments, in any of the sequencing methods described herein, the cleavable linker on the base comprises cleavable moiety including an azide, azido or azidomethyl group. In some embodiments, the cleavable moieties azide, azido and azidomethyl group are cleavable/removable with a phosphine compound. In some embodiments, the phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri(hydroxyproyl)phosphine (THPP). In some embodiments, the cleaving agent comprises 4-dimethylaminopyridine (4-DMAP).

In some embodiments, in any of the sequencing methods described herein, the chain terminating moiety (e.g., at the sugar 2' and/or sugar 3' position) and the cleavable linker on the base have the same or different cleavable moieties. In some embodiments, the chain terminating moiety (e.g., at the sugar 2' and/or sugar 3' position) and the detectable reporter moiety linked to the base are chemically cleavable/removable with the same chemical agent. In some embodiments, the chain terminating moiety (e.g., at the sugar 2' and/or sugar 3' position) and the detectable reporter moiety linked to the base are chemically cleavable/removable with different chemical agents.

Multivalent Molecules

The present disclosure provides compositions and methods for pairwise sequencing, including methods for sequencing the plurality of immobilized concatemer template molecules and methods for sequencing the plurality of retained forward extension strands, where the sequencing methods employ multivalent molecules. In some embodiments, in the sequencing methods, at least one multivalent molecule in the plurality of multivalent molecules of step (b) comprises: (1) a core; and (2) a plurality of nucleotide arms which comprise (i) a core attachment moiety, (ii) a spacer comprising a PEG moiety, (iii) a linker, and (iv) a nucleotide unit, wherein the core is attached to the plurality of nucleotide arms, wherein the spacer is attached to the linker, wherein the linker is attached to the nucleotide unit. In some embodiments, the nucleotide unit comprises a base, sugar and at least one phosphate group, and the linker is attached to the nucleotide unit through the base. In some embodiments, the linker comprises an aliphatic chain or an oligo ethylene glycol chain where both linker chains having 2-6 subunits. In some embodiments, the linker also includes an aromatic moiety. Exemplary multivalent molecules are shown in FIGS. 104-107. Exemplary nucleotide arms are shown in FIGS. 108 and 114. An exemplary spacer is shown in FIG. 109 (top), and exemplary linkers are shown in FIGS. 109 (bottom) and 110-113.

In some embodiments, in the sequencing methods, individual multivalent molecules in the plurality of multivalent molecules of step (b) comprise a core attached to multiple nucleotide arms, and wherein the multiple nucleotide arms have the same type of nucleotide unit which is selected from a group consisting of dATP, dGTP, dCTP, dTTP and dUTP. Alternatively, the multivalent molecule comprises a core attached to multiple nucleotide arms where different nucleotide arms are attached to a different type of nucleotide unit (e.g., dATP, dGTP, dCTP, dTTP or dUTP) and the multivalent molecule comprises any combination of two or more different nucleotide units.

In some embodiments, in the sequencing methods, the nucleotide unit of the at least one multivalent molecule of step (b) comprises an aromatic base, a five carbon sugar (e.g., ribose or deoxyribose), and one or more phosphate groups (e.g., 1-10 phosphate groups). The plurality of multivalent molecules can comprise one type of multivalent molecule having one type of nucleotide unit selected from a group consisting of dATP, dGTP, dCTP, dTTP and dUTP. The plurality of multivalent molecules can comprise at a mixture of any combination of two or more types of multivalent molecules, where individual multivalent molecules in the mixture comprise nucleotide units selected from a group consisting of dATP, dGTP, dCTP, dTTP and/or dUTP.

In some embodiments, in the sequencing methods, at least one multivalent molecule in the plurality of multivalent molecules of step (b) comprise a nucleotide unit having a chain of one, two or three phosphorus atoms where the chain is typically attached to the 5' carbon of the sugar moiety via an ester or phosphoramide linkage. In some embodiments, at least one nucleotide unit is a nucleotide analog having a phosphorus chain in which the phosphorus atoms are linked together with intervening O, S, NH, methylene or ethylene. In some embodiments, the phosphorus atoms in the chain include substituted side groups including O, S or BH$_3$. In some embodiments, the chain includes phosphate groups substituted with analogs including phosphoramidate, phosphorothioate, phosphordithioate, and O-methylphosphoroamidite groups.

In some embodiments, in the sequencing methods, individual multivalent molecules in the plurality of multivalent molecule of step (b) comprise a core attached to multiple nucleotide arms, and wherein individual nucleotide arms comprise a nucleotide unit having a chain terminating moiety (e.g., blocking moiety) at the sugar 2' position, at the sugar 3' position, or at the sugar 2' and 3' position. An exemplary nucleotide arm is shown in FIG. 108, and exemplary multivalent molecules are shown in FIGS. 104-107.

In some embodiments, in the sequencing methods, at least one multivalent molecule in the plurality of multivalent molecules of step (b) comprises a nucleotide unit comprising a terminator nucleotide analog having a chain terminating moiety (e.g., blocking moiety) at the sugar 2' position, at the sugar 3' position, or at the sugar 2' and 3' position. In some embodiments, the chain terminating moiety can inhibit polymerase-catalyzed incorporation of a subsequent nucleotide unit or free nucleotide in a nascent strand during a primer extension reaction. In some embodiments, the chain terminating moiety is attached to the 3' sugar hydroxyl position where the sugar comprises a ribose or deoxyribose sugar moiety. In some embodiments, the chain terminating moiety is removable/cleavable from the 3' sugar hydroxyl position to generate a nucleotide having a 3'OH sugar group which is extendible with a subsequent nucleotide in a polymerase-catalyzed nucleotide incorporation reaction. In some embodiments, the chain terminating moiety comprises an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group. In some embodiments, the chain terminating moiety is cleavable/removable from the nucleotide unit, for example by reacting the chain terminating moiety with a chemical agent, pH change, light or heat. In some embodiments, the chain terminating moieties alkyl, alkenyl, alkynyl and allyl are cleavable with tetrakis(triphenylphosphine)palladium(0) (Pd(PPh$_3$)$_4$) with piperidine, or with 2,3-Dichloro-5,6-dicyano-1,4-benzo-quinone (DDQ). In some embodiments, the chain terminating moieties aryl and benzyl are cleavable with H2 Pd/C. In some embodiments, the chain terminating moieties amine, amide, keto, isocyanate, phosphate, thio, disulfide are cleavable with phosphine or with a thiol group including beta-mercaptoethanol or dithiothritol (DTT). In some embodiments, the chain terminating moiety carbonate is cleavable with potassium carbonate (K$_2$CO$_3$) in MeOH, with triethylamine in pyridine, or with Zn in acetic acid (AcOH). In some embodiments, the chain terminating moieties urea and silyl are cleavable with tetrabutylammonium fluoride, pyridine-HF, with ammonium fluoride, or with triethylamine trihydrofluoride.

In some embodiments, in the sequencing methods, at least one multivalent molecule in the plurality of multivalent molecules of step (b) comprises a nucleotide unit comprising a terminator nucleotide analog having a chain terminating moiety (e.g., blocking moiety) at the sugar 2' position, at the sugar 3' position, or at the sugar 2' and 3' position. In some embodiments, the chain terminating moiety comprises an azide, azido or azidomethyl group. In some embodiments, the chain terminating moiety comprises a 3'-O-azido or 3'-O-azidomethyl group. In some embodiments, the chain terminating moieties azide, azido and azidomethyl group are cleavable/removable with a phosphine compound. In some embodiments, the phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri(hydroxyproyl)phosphine (THPP). In some embodiments, the cleaving agent comprises 4-dimethylaminopyridine (4-DMAP).

In some embodiments, in the sequencing methods, at least one multivalent molecule in the plurality of multivalent molecules of step (b) comprises a nucleotide unit comprising a chain terminating moiety which is selected from a group consisting of 3'-deoxy nucleotides, 2',3'-dideoxynucleotides, 3'-methyl, 3'-azido, 3'-azidomethyl, 3'-azidoalkyl, 3'-O-ethynyl, 3'-O-aminoalkyl, 3'-O-fluoroalkyl, 3'-fluoromethyl, 3'-difluoromethyl, 3'-trifluoromethyl, 3'-sulfonyl, 3'-malonyl, 3'-amino, 3'-O-amino, 3'-sulfhydral, 3'-aminomethyl, 3'-ethyl, 3'butyl, 3'-tert butyl, 3'-Fluorenylmethyloxycarbonyl, 3' tert-Butyloxycarbonyl, 3'-O-alkyl hydroxylamino group, 3'-phosphorothioate, and 3-O-benzyl, or derivatives thereof.

In some embodiments, in the sequencing methods, at least one multivalent molecule in the plurality of multivalent molecules of step (b) comprises a core attached to multiple nucleotide arms, wherein the core is labeled with detectable reporter moiety, or at least one nucleotide unit is labeled with a detectable reporter moiety, or at least one linker is labeled with a detectable reporter moiety. In some embodiments, the detectable reporter moiety comprises a fluorophore. In some embodiments, a particular detectable reporter moiety (e.g., fluorophore) that is attached to the multivalent molecule can correspond to the base (e.g., dATP, dGTP, dCTP, dTTP or dUTP) of the nucleotide unit to permit detection and identification of the nucleotide base.

In some embodiments, in the sequencing methods, at least one nucleotide arm of a multivalent molecule in the plurality of multivalent molecules of step (b) has a nucleotide unit that is attached to a detectable reporter moiety. In some embodiments, the detectable reporter moiety is attached to the nucleotide base. In some embodiments, the detectable reporter moiety comprises a fluorophore. In some embodiments, a particular detectable reporter moiety (e.g., fluorophore) that is attached to the multivalent molecule can correspond to the base (e.g., dATP, dGTP, dCTP, dTTP or dUTP) of the nucleotide unit to permit detection and identification of the nucleotide base.

In some embodiments in the sequencing methods, the core of the multivalent molecule can be labeled with a detectable reporter moiety (e.g., fluorophore) in a manner that permits distinction between different multivalent molecules carrying a different type of nucleotide unit. For example, the core of a first multivalent molecule is labeled with a first fluorophore, where the first multivalent molecule comprises multiple nucleotide-arms with dGTP nucleotide units. The core of a second multivalent molecule is labeled with a second fluorophore (which differs from the first fluorophore), where the second multivalent molecule comprises multiple nucleotide-arms with dATP nucleotide units. The binding and incorporating events of the nucleotide unit can be detected, and the specific base of the nucleotide unit (as part of the multivalent molecule) can be identified based on detection and identification of the detectable reporter moiety on the first and second core.

In some embodiments in the sequencing methods, at least one linker of a nucleotide-arm of a multivalent molecule can be labeled with a detectable reporter moiety (e.g., fluorophore) in a manner that permits distinction between different multivalent molecules carrying a different type of nucleotide unit. For example, at least one linker of a first multivalent molecule is labeled with a first fluorophore, where the first multivalent molecule comprises multiple nucleotide-arms with dGTP nucleotide units. At least one linker of a second multivalent molecule is labeled with a second fluorophore (which differs from the first fluorophore), where the second multivalent molecule comprises multiple nucleotide-arms with dATP nucleotide units. The binding and incorporating events of the nucleotide units can be detected, and the specific base of the nucleotide unit (as part of the multivalent molecule) can be identified based on detection and identification of the detectable reporter moiety on the first and second linkers.

In some embodiments in the sequencing methods, at least one nucleotide unit (e.g., nucleo-base) of a nucleotide-arm of a multivalent molecule can be labeled with a detectable reporter moiety (e.g., fluorophore) in a manner that permits distinction between different multivalent molecules carrying a different type of nucleotide unit. For example, at least one nucleotide unit of a first multivalent molecule is labeled with a first fluorophore, where the first multivalent molecule comprises multiple nucleotide-arms with dGTP nucleotide units. At least one nucleotide unit of a second multivalent molecule is labeled with a second fluorophore (which differs from the first fluorophore), where the second multivalent molecule comprises multiple nucleotide-arms with dATP nucleotide units. The binding and incorporating events of the nucleotide units can be detected, and the specific base of the nucleotide unit (as part of the multivalent molecule) can be identified based on detection and identification of the detectable reporter moiety on the first and second nucleotide units.

In some embodiments, in the sequencing methods, the core of a multivalent molecule of step (b) comprises a streptavidin-type or avidin-type moiety and the core attachment moiety comprises biotin. In some embodiments, the core comprises an streptavidin-type or avidin-type moiety which includes a streptavidin or avidin protein, as well as any derivatives, analogs and other non-native forms of avidin that can bind to at least one biotin moiety. Other forms of streptavidin or avidin moieties include native and recombinant avidin and streptavidin as well as derivatized molecules, e.g. non-glycosylated avidin and truncated streptavidins. For example, avidin moiety includes de-glycosylated forms of avidin, bacterial streptavidin produced by *Streptomyces* (e.g., *Streptomyces avidinii*), as well as derivatized forms, for example, N-acyl avidins, e.g., N-acetyl, N-phthalyl and N-succinyl avidin, and the commercially-available products ExtrAvidin™, Captavidin™, Neutravidin™, and Neutralite Avidin™.

In some embodiments, in the sequencing methods, the core of a multivalent molecule of step (b) comprises an streptavidin-type or avidin-type moiety which is labeled with at least one detectable reporter moiety, such as for example a fluorophore. The streptavidin-type or avidin-type core can be labeled with 1, 2, 3, 4 or more detectable moieties. The streptavidin-type or avidin-type core can be labeled with one or more of the same type of detectable reporter moiety. In some embodiments, a particular detectable reporter moiety (e.g., fluorophore) that is attached to the streptavidin-type or avidin-type core can correspond to the base (e.g., dATP, dGTP, dCTP, dTTP or dUTP) of the nucleotide units to permit detection and identification of the multivalent molecule.

It is postulated that an increase in binding of a nucleotide to an enzyme (e.g., polymerase) or an enzyme complex can be effected by increasing the effective concentration of the nucleotide. The increase can be achieved by increasing the concentration of the nucleotide in free solution, or by increasing the amount of the nucleotide in proximity to the relevant binding site. The increase can also be achieved by physically restricting a number of nucleotides into a limited volume thus resulting in a local increase in concentration, and such as structure may thus bind to the binding site with a higher apparent avidity than would be observed with unconjugated, untethered, or otherwise unrestricted individual nucleotides. One exemplary means of effecting such restriction is by providing a multivalent molecule in which multiple nucleotides are bound to a particle (or core) such as a polymer, a branched polymer, a dendrimer, a micelle, a liposome, a microparticle, a nanoparticle, a quantum dot, or other suitable particle known in the art.

The multivalent molecule can increase the effective concentration of the nucleotide in free solution, or can increase the amount of nucleotide in proximity to the nucleotide binding site or the nucleotide incorporation site of the polymerase. The increase in effective concentration can also be achieved by physically restricting the number of nucleotides into a limited volume, thus increasing the local nucleotide concentration. The multivalent molecule can bind to the polymerase with an increased apparent avidity compared to an unconjugated nucleotide. When the nucleotide unit is complementary to the interrogation position in the template molecule, the multivalent molecule forms a binding complex with the polymerase and the template molecule, and the binding complex exhibits increased stability and longer persistence time than a binding complex formed using a single unconjugated or untethered nucleotide (e.g., a free nucleotide). When bound to a polymerase, the multivalent molecule can increase the local concentration of nucleotides increases many-fold, which in turn enhances signal intensity. When bound to a polymerase, the multivalent molecule can exhibit longer persistence time which can shorten the imaging a fluorescent signal for the detecting and identifying steps. When bound to a polymerase, the multivalent molecule forms a stable complex with the polymerase. The stable complex can withstand washing steps, so that the signal intensity remains high throughout the imaging and washing steps. The stable complex can be dissociated (e.g., by changing buffer composition) so that the primed target nucleic acid can undergo extension in a subsequent reaction with a free nucleotide.

The multivalent molecule can be used to localize detectable signals to active regions of biochemical interactions, such as sites of protein-nucleic acid interactions, nucleic acid hybridization reactions, or enzymatic reactions, such as polymerase reactions. For example, the multivalent molecules described herein can be utilized to identify sites of base binding to a nucleic acid template molecule or base incorporation in elongating nucleic acid chains during polymerase-catalyzed reactions and to provide base discrimination for sequencing and array based applications. The increased binding between the nucleic acid template molecule and the nucleotide unit of the multivalent binding composition, when the nucleotide is complementary to the target nucleic acid, provides enhanced signal that greatly improve base call accuracy and shortens imaging time.

In addition, the use of multivalent molecules allows sequencing signals from a given template molecule to originate within polony regions containing multiple copies of the template sequence. Sequencing methods that include multiple copies of a target sequence (e.g., concatemer molecules) have the advantage that signals can be amplified due to the presence of multiple simultaneous sequencing reactions within the defined region, each providing its own signal. The presence of multiple signals within a defined area also reduces the impact of any single skipped cycle, due to the fact that the signal from a large number of correct base calls can overwhelm the signal from a smaller number of skipped or incorrect base calls, therefore providing methods for reducing phasing errors and/or to improve read length in sequencing reactions.

The multivalent molecules and their use disclosed herein lead to one or more of: (i) stronger signal for better base-calling accuracy compared to conventional nucleic acid amplification and sequencing methodologies; ii) allow greater discrimination of sequence-specific signal from background signals; (iii) reduced requirements for the amount of starting material necessary, (iv) increased sequencing rate and shortened sequencing time; (v) reducing phasing errors, and (vi) improving read length in sequencing reactions.

One of ordinary skill would recognize that in a series of iterative sequencing reactions, occasionally one or more sites will fail to incorporate a nucleotide during a given cycle, thus leading one or more sites to be unsynchronized with the bulk of the elongating nucleic acid chains. Under a condition in which sequencing signals are derived from reactions occurring on single copies of a target nucleic acid, these failures to incorporate will yield discrete errors in the output sequence. Use of the multivalent molecules for sequencing can reduce this type of error in sequencing reactions. For example, the use of multivalent substrates that are capable of binding to a polymerase-template-primer complex, or capable of incorporation into the elongating strand, by providing increased probabilities of rebinding upon premature dissociation of a ternary polymerase complex, can reduce the frequency of "skipped" cycles in which a base is not incorporated. Thus, in some embodiments, the present disclosure contemplates the use of multivalent molecules as disclosed herein comprising a nucleotide having a free, or reversibly modified, 5' phosphate, diphosphate, or triphosphate moiety, and wherein the nucleotide is connected to the particle or polymer as disclosed herein, through a labile or cleavable linkage. In some embodiments, the present disclosure contemplates a reduction in the intrinsic error rate due to skipped incorporations as a result of the use of the multivalent substrates disclosed herein.

When each sequencing cycle proceeds perfectly, each reaction within the defined region will provide an identical signal. However, as noted elsewhere herein, in a series of iterative sequencing reactions, occasionally one or more sites will fail to incorporate a nucleotide during a given cycle, thus leading one or more sites to be unsynchronized with the bulk of the elongating nucleic acid chains. This issue, referred to as "phasing," leads to degradation of the sequencing signal as the signal is contaminated with spurious signals from sites having skipped one or more cycles. This, in turn, creates the potential for errors in base identification. The progressive accumulation of skipped cycles through multiple cycles also reduces the effective read length, due to progressive degradation of the sequencing signal with each cycle. It is a further object of this disclosure to provide methods for reducing phasing errors and/or to improve read length in sequencing reactions.

Sequencing methods that employ multivalent molecules can result in reduced error rate as indicated by reduction in the misidentification of bases, the reporting of nonexistent bases, or the failure to report correct bases. In some embodiments, the reduction in the error rate can in be a reduction of about 5%, 10%, 15%, 20% 25%, 50%, 75%, 100%, 150%, 200%, or more compared to the error rate observed using monovalent ligands, including free nucleotides, labeled free nucleotides, protein or peptide bound nucleotides, or labeled protein or peptide bound nucleotides.

Sequencing methods that employ multivalent molecules can result in increased average read length of about 5%, 10%, 15%, 20% 25%, 50%, 75%, 100%, 150%, 200%, 300%, or more compared to the average read length observed using monovalent ligands, including free nucleotides, labeled free nucleotides, protein or peptide bound nucleotides, or labeled protein or peptide bound nucleotides.

Sequencing methods that employ multivalent molecules can result in increased in average read length of about 10, 20, 25, 30, 50, 75, 100, 125, 150, 200, 250, 300, 350, 400, 500 nucleotides, or more compared to the average read length observed using monovalent ligands, including free nucleotides, labeled free nucleotides, protein or peptide bound nucleotides, or labeled protein or peptide bound nucleotides.

The use of the multivalent molecules for sequencing may effectively shortens the sequencing time. The sequencing reaction cycle comprising the contacting, detecting, and incorporating steps is performed in a total time ranging from about 5 minutes to about 60 minutes. In some embodiments, the sequencing reaction cycle is performed in at least 5 minutes, at least 10 minutes, at least 20 minutes, at least 30 minutes, at least 40 minutes, at least 50 minutes, or at least 60 minutes. In some embodiments, the sequencing reaction cycle is performed in at most 60 minutes, at most 50 minutes, at most 40 minutes, at most 30 minutes, at most 20 minutes, at most 10 minutes, or at most 5 minutes. Any of the lower and upper values described in this paragraph may be combined to form a range included within the present disclosure, for example, in some embodiments the sequencing reaction cycle may be performed in a total time ranging from about 10 minutes to about 30 minutes. Those of skill in the art will recognize that the sequencing cycle time may have any value within this range, e.g., about 16 minutes.

The use of the multivalent molecules for sequencing may provide improved accuracy base readout. The disclosed compositions and methods for nucleic acid sequencing will provide an average Q-score for base-calling accuracy over a sequencing run that ranges from about 20 to about 50. In some embodiments, the average Q-score is at least 20, at least 25, at least 30, at least 35, at least 40, at least 45, or at least 50. Those of skill in the art will recognize that the average Q-score may have any value within this range, e.g., about 32. In some embodiments, the disclosed compositions and methods for nucleic acid sequencing will provide a Q-score of greater than 30 for at least 50%, at least 60%, at least 70%, at least 80%, at least 85%, at least 90%, at least 95%, at least 98%, or at least 99% of the terminal (or N+1) nucleotides identified. In some embodiments, the disclosed compositions and methods for nucleic acid sequencing will provide a Q-score of greater than 35 for at least 50%, at least 60%, at least 70%, at least 80%, at least 85%, at least 90%, at least 95%, at least 98%, or at least 99% of the terminal (or N+1) nucleotides identified. In some embodiments, the disclosed compositions and methods for nucleic acid sequencing will provide a Q-score of greater than 40 for at least 50%, at least 60%, at least 70%, at least 80%, at least 85%, at least 90%, at least 95%, at least 98%, or at least 99% of the terminal (or N+1) nucleotides identified. In some embodiments, the disclosed compositions and methods for nucleic acid sequencing will provide a Q-score of greater than 45 for at least 50%, at least 60%, at least 70%, at least 80%, at least 85%, at least 90%, at least 95%, at least 98%, or at least 99/o of the terminal (or N+1) nucleotides identified. In some embodiments, the disclosed compositions and methods for nucleic acid sequencing will provide a Q-score of greater than 50 for at least 50%, at least 60%, at least 70%, at least 80%, at least 85%, at least 90%, at least 95%, at least 98%, or at least 99% of the terminal (or N+1) nucleotides identified.

In some embodiments, a multivalent molecule comprises a core comprising a branched polymer; a dendrimer; a cross linked polymer particle such as an agarose, polyacrylamide, acrylate, methacrylate, cyanoacrylate, methyl methacrylate particle; a glass particle; a ceramic particle; a metal particle; a quantum dot; a liposome; an emulsion particle, or any other particle (e.g., nanoparticles, microparticles, or the like) known in the art.

The particle or core can also have a binding moiety. In some embodiments, particles or cores may self-associate without the use of a separate interaction moiety. In some embodiments, particles or cores may self-associate due to buffer conditions or salt conditions, e.g., as in the case of calcium-mediated interactions of hydroxyapatite particles, lipid or polymer mediated interactions of micelles or liposomes, or salt-mediated aggregation of metallic (such as iron or gold) nanoparticles.

The multivalent molecules can have one or more labels (e.g., detectable reporter moieties). Examples of the labels include but are not limited to fluorophores, spin labels, metals or metal ions, colorimetric labels, nanoparticles, PET labels, radioactive labels, or other such label as may render said composition detectable by such methods as are known in the art of the detection of macromolecules or molecular interactions. The label may be attached to the nucleotide (e.g. by attachment to the base or the 5' phosphate moiety of a nucleotide), to the particle itself (e.g., to the PEG subunits) or to the core (e.g., to the streptavidin or avidin core), to an end of the polymer, to a central moiety, or to any other location within multivalent molecule which would be recognized by one of skill in the art to be sufficient to render said composition, such as a particle, detectable by such methods as are known in the art or described elsewhere herein. In some embodiments, a given multivalent molecule is labeled with a known fluorophore to permit differentiation and identification of the nucleo-bases of the give multivalent molecule.

One example of the multivalent molecule is a polymer-nucleotide conjugate. Examples of the branched polymer include polyethylene glycol (PEG), polypropylene glycol, polyvinyl alcohol, polylactic acid, polyglycolic acid, polyglycine, polyvinyl acetate, a dextran, or other such polymers. In one embodiment, the polymer is a PEG. In another embodiment, the polymer can have PEG branches.

Suitable polymers may be characterized by a repeating unit having a functional group suitable for derivatization such as an amine, a hydroxyl, a carbonyl, or an allyl group. The polymer can also have one or more pre-derivatized substituents such that one or more particular subunits comprise a site of derivatization or a branch site, whether or not other subunits include the same site, substituent, or moiety. A pre-derivatized substituent may comprise or may further comprise, for example, a nucleotide, a nucleoside, a nucleotide analog, a label such as a fluorescent label, radioactive label, or spin label, an interaction moiety, an additional polymer moiety, or the like, or any combination of the foregoing.

In the multivalent molecule (e.g., polymer-nucleotide conjugate), the polymer can have a plurality of branches. The branched polymer can have various configurations, including but not limited to stellate ("starburst") forms, aggregated stellate ("helter skelter") forms, bottle brush, or dendrimer. The branched polymer can radiate from a central attachment point or central moiety, or may include multiple branch points, such as, for example, 2, 3, 4, 5, 6, 7, 8, 9, 10, or more branch points. In some embodiments, each subunit of a polymer may optionally constitute a separate branch point. An exemplary nucleotide arm is shown in FIG. 108, and exemplary multivalent molecules are shown in FIGS. 104-107.

In the multivalent molecule, the length and size of the branch can differ based on the type of polymer. In some branched polymers, the branch may have a length of between 1 and 1,000 nm, between 1 and 100 nm, between 1 and 200 nm, between 1 and 300 nm, between 1 and 400 nm, between 1 and 500 nm, between 1 and 600 nm, between 1 and 700 nm, between 1 and 800 nm, or between 1 and 900 nm, or more, or having a length falling within or between any of the values disclosed herein. In some branched polymers, the branch may have a size corresponding to an apparent molecular weight of 1K, 2K, 3K, 4K, 5K, 10K, 15K, 20K, 30K, 50K, 80K, 100K, or any value within a range defined by any two of the foregoing. The apparent molecular weight of a polymer may be calculated from the known molecular weight of a representative number of subunits, as determined by size exclusion chromatography, as determined by mass spectrometry, or as determined by any other method as is known in the art. The polymer can have multiple branches. The number of branches in the polymer can be 2, 3, 4, 5, 6, 7, 8, 12, 16, 24, 32, 64, 128 or more, or a number falling within a range defined by any two of these values.

For the multivalent molecule (e.g., polymer-nucleotide conjugate), the branched polymer of 4, 8, 16, 32, or 64 branches can have nucleotides attached to the ends of PEG branches, such that each end has attached thereto 0, 1, 2, 3, 4, 5, 6 or more nucleotides. In one non-limiting example, the branched polymer of between 3 and 128 PEG arms having attached to the polymer branches ends one or more nucleotides, such that each end has attached thereto 0, 1, 2, 3, 4, 5, 6 or more nucleotides or nucleotide analogs. In some embodiments, a branched polymer or dendrimer has an even number of arms. In some embodiments, a branched polymer or dendrimer has an odd number of arms.

In the multivalent molecule (e.g., polymer-nucleotide conjugate), each branch or a subset of branches of the polymer may have attached thereto a moiety comprising a nucleotide (e.g., an adenine, a thymine, a uracil, a cytosine, or a guanine residue or a derivative or mimetic thereof), and the moiety is capable of binding to a polymerase, reverse transcriptase, or other nucleotide binding domain. Optionally, the nucleotide moiety may be capable of binding to a polymerase-template-primer complex but not incorporate, or can incorporate into an elongating nucleic acid chain during a polymerase reaction. In some embodiments, the nucleotide moiety comprises a chain terminating moiety which blocks incorporation of a subsequent nucleotide during a polymerase-mediated reaction. In some embodiments, the nucleotide moiety may be unblocked (reversibly blocked) such that a subsequent nucleotide is not capable of being incorporated into an elongating nucleic acid chain during a polymerase reaction until such block is removed, after which the subsequent nucleotide is then capable of being incorporated into an elongating nucleic acid chain during a polymerase reaction.

The multivalent molecule can further have a binding moiety in each branch or a subset of branches. Some examples of the binding moiety include but are not limited to biotin, avidin, streptavidin or the like, polyhistidine domains, complementary paired nucleic acid domains, G-quartet forming nucleic acid domains, calmodulin, maltose-binding protein, cellulase, maltose, sucrose, glutathione-S-transferase, glutathione, O-6-methylguanine-DNA methyltransferase, benzylguanine and derivatives thereof, benzylcysteine and derivatives thereof, an antibody, an epitope, a protein A, a protein G. The binding moiety can be any interactive molecules or fragment thereof known in the art to bind to or facilitate interactions between proteins, between proteins and ligands, between proteins and nucleic acids, between nucleic acids, or between small molecule interaction domains or moieties.

In some embodiments, the multivalent molecule may comprise one or more elements of a complementary interaction moiety. Exemplary complementary interaction moieties include, for example, biotin and avidin; SNAP-benzylguanosine; antibody or FAB and epitope; IgG FC and Protein A, Protein G, ProteinA/G, or Protein L; maltose binding protein and maltose; lectin and cognate polysaccharide; ion chelation moieties, complementary nucleic acids, nucleic acids capable of forming triplex or triple helical interactions; nucleic acids capable of forming G-quartets, and the like. One of skill in the art will readily recognize that many pairs of moieties exist and are commonly used for their property of interacting strongly and specifically with one another; and thus any such complementary pair or set is considered to be suitable for this purpose in constructing or envisioning the compositions of the present disclosure. In some embodiments, a composition as disclosed herein may comprise compositions in which one element of a complementary interaction moiety is attached to one molecule or multivalent ligand, and the other element of the complementary interaction moiety is attached to a separate molecule or multivalent ligand. In some embodiments, a composition as disclosed herein may comprise compositions in which both or all elements of a complementary interaction moiety are attached to a single molecule or multivalent ligand. In some embodiments, a composition as disclosed herein may comprise compositions in which both or all elements of a complementary interaction moiety are attached to separate arms of, or locations on, a single molecule or multivalent ligand. In some embodiments, a composition as disclosed herein may comprise compositions in which both or all elements of a complementary interaction moiety are attached to the same arm of, or locations on, a single molecule or multivalent ligand. In some embodiments, compositions comprising one element of a complementary interaction moiety and compositions comprising another element of a complementary interaction moiety may be simultaneously or sequentially mixed. In some embodiments, interactions between molecules or particles as disclosed herein allow for the association or aggregation of multiple molecules or particles such that, for example, detectable signals are increased. In some embodiments, fluorescent, colorimetric, or radioactive signals are enhanced. In other embodiments, other interaction moieties as disclosed herein or as are known in the art are contemplated. In some embodiments, a composition as provided herein may be provided such that one or more molecules comprising a first interaction moiety such as, for example, one or more imidazole or pyridine moieties, and one or more additional molecules comprising a second interaction moiety such as, for example, histidine residues, are simultaneously or sequentially mixed. In some embodiments, said composition comprises 1, 2, 3, 4, 5, 6, or more imidazole or pyridine moieties. In some embodiments, said composition comprises 1, 2, 3, 4, 5, 6, or more histidine residues. In such embodiments, interaction between the molecules or particles as provided may be facilitated by the presence of a divalent cation such as nickel, manganese, magnesium, calcium, strontium, or the like. In some embodiments, for example, a (His)3 group may interact with a (His)3 group on another molecule or particle via coordination of a nickel or manganese ion.

The multivalent binding composition may comprise one or more buffers, salts, ions, or additives. In some embodiments, representative additives may include, but are not limited to, betaine, spermidine, detergents such as Triton X-100, Tween 20, SDS, or NP-40, ethylene glycol, polyethylene glycol, dextran, polyvinyl alcohol, vinyl alcohol, methylcellulose, heparin, heparan sulfate, glycerol, sucrose, 1,2-propanediol, DMSO, N,N,N-trimethylglycine, ethanol, ethoxyethanol, propylene glycol, polypropylene glycol, block copolymers such as the Pluronic (r) series polymers, arginine, histidine, imidazole, or any combination thereof, or any substance known in the art as a DNA "relaxer" (a compound, with the effect of altering the persistence length of DNA, altering the number of within-polymer junctions or crossings, or altering the conformational dynamics of a DNA molecule such that the accessibility of sites within the strand to DNA binding moieties is increased).

The multivalent molecules may include zwitterionic compounds as additives. Further representative additives may be found in Lorenz, T. C. J. Vis. Exp. (63), e3998, doi:10.3791/3998 (2012), which is hereby incorporated by reference with respect to its disclosure of additives for the facilitation of nucleic acid binding or dynamics, or the facilitation of processes involving the manipulation, use, or storage of nucleic acids.

In some embodiments, the sequencing reaction comprises multivalent molecules, polymerases, primed template molecules and at least one cation known in the art to facilitate nucleic acid interactions, such as self-association, secondary or tertiary structure formation, base pairing, surface association, peptide association, protein binding, or the like. Examples of the cations include, but are not limited to, sodium, magnesium, strontium, barium, potassium, manganese, calcium, lithium, nickel, cobalt, or other such cations.

When the multivalent molecules are used to replace an unconjugated or untethered nucleotide to form a complex with the polymerase and the nucleic acid template molecule, the local concentration of the nucleotide is increased many folds, which in turn enhances the signal intensity, particularly the correct signal versus mismatch. The present disclosure contemplates contacting the multivalent binding composition with a polymerase and a primed template molecule to determine the formation of a ternary binding complex.

Because of the increased local concentration of the nucleotide on the polymer-nucleotide conjugate, the binding between the polymerase, the primed template strand, and the nucleotide, when the nucleotide is complementary to the next base of the template strand, becomes more favorable. The formed binding complex has a longer persistence time which in turn helps shorten the imaging step. The high signal intensity resulted from the use of the polymer nucleotide conjugate remain for the entire binding and imaging step. The strong binding between the polymerase, the primed template strand, and the nucleotide or nucleotide analog also means that the formed binding complex will remain stabilized during the washing step and the signal will remain at a high intensity when other reaction mixture and unmatched nucleotide analogs are washed away. After the imaging step, the binding complex can be destabilized and the primed template strand can then be extended for one base. After the extension, the binding and imaging steps can be repeated again with the use of the polymer nucleotide conjugate to determine the identity of the next base.

The compositions and methods of the present disclosure provide a robust and controllable means of establishing and maintaining a ternary enzyme complex (e.g., during sequencing), as well as providing vastly improved means by which the presence of said complex may be identified and/or measured, and a means by which the persistence of said complex may be controlled. This provides important solutions to problems such as that of determining the identity of the N+1 base in nucleic acid sequencing applications.

Without intending to be bound by any particular theory, it has been observed that multivalent binding compositions disclosed herein associate with polymerase nucleotide complexes in order to form a ternary binding complexes with a rate that is time-dependent, though substantially slower than the rate of association known to be obtainable by nucleotides in free solution. Thus, the on-rate (Kon) is substantially and surprisingly slower than the on rate for single nucleotides or nucleotides not attached to multivalent ligand complexes. Importantly, however, the off rate (Koff) of the multivalent ligand complex is substantially slower than that observed for nucleotides in free solution. Therefore, the multivalent ligand complexes of the present disclosure provide a surprising and beneficial improvement of the persistence of ternary polymerase-polynucleotide-nucleotide complexes (especially over such complexes that are formed with free nucleotides) allowing, for example, significant improvements in imaging quality for nucleic acid sequencing applications, over currently available methods and reagents. Importantly, this property of the multivalent substrates disclosed herein renders the formation of visible ternary complexes controllable, such that subsequent visualization, modification, or processing steps may be undertaken essentially without regard to the dissociation of the complex—that is, the complex can be formed, imaged, modified, or used in other ways as necessary, and will remain stable until a user carries out an affirmative dissociation step, such as exposing the complexes to a dissociation buffer.

Compositions and methods for preparing and using the multivalent molecules (also called polymer-nucleotide conjugates) are described in U.S. Ser. No. 16/579,794, filed on Sep. 23, 2019, the contents of which is hereby expressly incorporated by reference in its entirety.

Sequencing Polymerases

The present disclosure provides compositions and methods for pairwise sequencing, including methods for sequencing the plurality of immobilized concatemer template molecules and methods for sequencing the plurality of retained forward extension strands, where any of the sequencing methods described herein employ at least one type of sequencing polymerase and a plurality of nucleotides. In some embodiments, the sequencing polymerase(s) is/are capable of incorporating a complementary nucleotide opposite a nucleotide having a scissile moiety in the immobilized concatemer template molecules. In some embodiments, the plurality of sequencing polymerases comprise recombinant sequencing polymerases.

Examples of suitable polymerases for use in sequencing with nucleotides include but are not limited to: Klenow DNA polymerase; *Thermus aquaticus* DNA polymerase I (Taq polymerase); KlenTaq polymerase; Candidatus altiarchaeales archaeon; Candidatus Hadarchaeum Yellowstonense; Hadesarchaea archaeon; Euryarchaeota archaeon; Thermoplasmata archaeon; *Thermococcus* polymerases such as *Thermococcus litoralis*, bacteriophage T7 DNA polymerase; human alpha, delta and epsilon DNA polymerases; bacteriophage polymerases such as T4, RB69 and phi29 bacteriophage DNA polymerases; *Pyrococcus furiosus* DNA polymerase (Pfu polymerase); *Bacillus subtilis* DNA polymerase III; *E. coli* DNA polymerase III alpha and epsilon; 9 degree N polymerase; reverse transcriptases such as HIV type M or O reverse transcriptases; avian myeloblastosis virus reverse transcriptase; Moloney Murine Leukemia Virus (MMLV) reverse transcriptase; or telomerase. Further non-limiting examples of DNA polymerases include those from various Archaea genera, such as, Aeropyrum, Archaeglobus, Desulfurococcus, *Pyrobaculum, Pyrococcus*, Pyrolobus, Pyrodictium, *Staphylothermus, Stetteria, Sulfolobus, Thermococcus*, and Vulcanisaeta and the like or variants thereof, including such polymerases as are known in the art such as 9 degrees N™, Vent®, Deep Vent®, Therminator™, Pfu, KOD, Pfx, Tgo and RB69 polymerases.

The present disclosure provides compositions and methods for pairwise sequencing, including methods for sequencing the plurality of immobilized concatemer template molecules and methods for sequencing the plurality of retained forward extension strands, where any of the sequencing methods described herein employ a first type of sequencing polymerase and a plurality of multivalent molecules, and a second type of sequencing polymerase and a plurality of nucleotides. In some embodiments, the first sequencing polymerases are capable of binding a complementary nucleotide unit of a multivalent molecule opposite a nucleotide having a scissile moiety (e.g., uridine, 8-oxoG or deoxyinosine) in the immobilized concatemer template molecules. In some embodiments, the second sequencing polymerases are capable of incorporating a complementary nucleotide opposite a nucleotide having a scissile moiety (e.g., uridine, 8-oxoG or deoxyinosine) in the immobilized concatemer template molecules. In some embodiments, the plurality of first and second sequencing polymerases comprise recombinant sequencing polymerases. In some embodiments, the plurality of first and second sequencing polymerases comprise one, two or more substitution mutations that confer an exonuclease minus property.

Examples of suitable first and/or second sequencing polymerases for use in sequencing with multivalent molecules and nucleotides include but are not limited to: Klenow DNA polymerase; *Thermus aquaticus* DNA polymerase I (Taq polymerase); KlenTaq polymerase; Candidatus altiarchaeales archaeon; Candidatus Hadarchaeum Yellowstonense; Hadesarchaea archaeon; Euryarchaeota archaeon; Thermoplasmata archaeon; *Thermococcus* polymerases such as *Thermococcus litoralis*, bacteriophage T7 DNA polymerase; human alpha, delta and epsilon DNA polymerases; bacteriophage polymerases such as T4, RB69 and phi29 bacteriophage DNA polymerases; *Pyrococcus furiosus* DNA polymerase (Pfu polymerase); *Bacillus subtilis* DNA polymerase III; *E. coli* DNA polymerase III alpha and epsilon; 9 degrees N™ polymerase; reverse transcriptases such as HIV type M or O reverse transcriptases; avian myeloblastosis virus reverse transcriptase; Moloney Murine Leukemia Virus (MMLV) reverse transcriptase; or telomerase. Further non-limiting examples of DNA polymerases include those from various Archaea genera, such as, Aeropyrum, Archaeglobus, Desulfurococcus, *Pyrobaculum, Pyrococcus*, Pyrolobus, Pyrodictium, *Staphylothermus, Stetteria, Sulfolobus, Thermococcus*, and Vulcanisaeta and the like or variants thereof, including such polymerases as are known in the art such as 9 degrees N™, Vent®, Deep Vent®, Therminator™, Pfu, KOD, Pfx, Tgo and RB69 polymerases.

In some embodiments, the plurality of first and/or second sequencing polymerases comprise mutant polymerases that exhibit increased incorporation rate of nucleotide analogs and/or increased fidelity compared to a wild type polymerase. In some embodiments, the nucleotide analogs comprise a chain terminating moiety (e.g., blocking moiety) at the sugar 2' position and/or at the 3' sugar position. In some embodiments, the plurality of first and/or second sequencing polymerases exhibit increased thermal stability compared to a wild type polymerase. In some embodiments, the plurality of first and/or second sequencing polymerases exhibit increased ability to incorporate a nucleotide into the 3' end of a primer or incorporate a nucleotide into a nascent strand in a primer extension reaction when the template molecule includes at least one uridine (e.g., uracil-tolerant sequencing polymerase). In some embodiments, the first polymerases have the same or different amino acid sequence as the second polymerases.

In some embodiments, polymerases that are suitable for conducting a sequencing reaction include polymerases that can bind a nucleic acid duplex (e.g., a template molecule hybridized to a primer) to form a complexed polymerase, where the complexed polymerase can bind a nucleotide to form a binding complex. The binding complex can transition to become a ternary complex.

In some embodiments, polymerases (e.g., first polymerases) that are suitable for conducting a sequencing reaction include polymerases that can bind a nucleic acid duplex (e.g., a template molecule hybridized to a primer) to form a complexed polymerase, where the complexed polymerase can bind a nucleotide unit of a multivalent molecule to form a binding complex. The binding complex can transition to become a ternary complex.

In some embodiments, polymerases (e.g., second polymerases) that are suitable for conducting a sequencing reaction include polymerases that can bind a nucleic acid duplex (e.g., a template molecule hybridized to a primer) to form a complexed polymerase, where the complexed polymerase can bind a nucleotide to form a binding complex. The binding complex can transition to become a ternary complex.

Any suitable sequencing polymerase described herein can form a binding complex that can transition into a ternary complex when the free nucleotide, or nucleotide unit of a multivalent molecule, binds to the 3' end of the nucleic acid primer (as part of the nucleic acid duplex) at a position that is opposite a complementary nucleotide in the nucleic acid template molecule.

The ternary complex has a longer persistence time when the nucleotide unit of a multivalent molecule is complementary to the target nucleic acid compared to the persistence time of a non-complementary nucleotide unit. The ternary complex also has a longer persistence time when a nucleotide unit of a multivalent molecule is complementary to the target nucleic acid compared to a complementary free nucleotide. In some embodiments, the ternary complexes have a persistence time of greater than about 0.1, 0.2, 0.3, 0.4, 0.5, 0.6, 0.7, 0.8, 0.9, 1 second or more than 30 seconds. For example, in some embodiments, the ternary complexes have a persistence time of greater than about 0.1-0.25 seconds, or about 0.25-0.5 seconds, or about 0.5-0.75 seconds, or about 0.75-1 second, or about 1-2 seconds, or about 2-3 seconds, or about 3-4 second, or about 4-5 seconds, or about 5-30 seconds or more than 30 seconds and/or wherein the method is or may be carried out at a temperature of at or above 15° C., at or above 20° C., at or above 25° C., at or above 35° C., at or above 37° C., at or above 42° C. at or above 55° C. at or above 60° C., or at or above 72° C., or within a range defined by any of the foregoing. In some embodiments, the ternary complexes may have a persistence time of less than 1s, greater than 1s, greater than 2s, greater than 3s, greater than 5s, greater than 10s, greater than 15s, greater than 20s, greater than 30s, greater than 60s, greater than 120s, greater than 360s, greater than 3600s, or more, or for a time lying within a range defined by any two or more of these values. The ternary complex (e.g., binding complex) remains stable until subjected to a condition that causes dissociation of interactions between any of the polymerase, template molecule, primer and/or the nucleotide unit or the nucleotide. For example, a dissociating condition comprises contacting the binding complex with any one or any combination of a detergent, EDTA and/or water.

The persistence time can be measured, for example, by observing the onset and/or duration of a ternary complex, such as by observing a signal from a labeled component of the ternary complex. For example, a labeled nucleotide or a labeled reagent comprising one or more nucleotides may be present in a ternary complex, thus allowing the signal from the label to be detected during the persistence time of the ternary complex.

It has been observed that different ranges of persistence times are achievable with different salts or ions, showing, for example, that complexes formed in the presence of, for example, magnesium or manganese form more quickly than complexes formed with other ions. It has also been observed that complexes formed in the presence of, for example, strontium or barium, form readily and dissociate completely or with substantial completeness upon withdrawal of strontium or barium, or upon washing with a buffer lacking strontium or barium.

The dissociation of ternary complexes can be controlled by changing the buffer conditions. During a sequencing method, an imaging step can be used to detect and/or identify a nucleotide unit bound to a nucleic acid duplex in a ternary complex. After the imaging step, a buffer with increased salt content can be used to dissociate the ternary complexes such that labeled multivalent molecules can be washed out, providing a means by which signals can be attenuated or terminated, such as in the transition between one sequencing cycle and the next. This dissociation may be effected, in some embodiments, by washing the complexes with a buffer lacking a necessary metal or cofactor. In some embodiments, a wash buffer may comprise one or more reagents for the purpose of maintaining pH control. In some embodiments, a wash buffer may comprise one or more monovalent cations, such as sodium. In some embodiments, a wash buffer lacks or substantially lacks a divalent cation, for example, having no or substantially no strontium, barium, calcium, magnesium, or manganese. In some embodiments, a wash buffer further comprises a chelating agent, such as, for example, EDTA, EGTA, nitrilotriacetic acid, polyhistidine, imidazole, or the like. In some embodiments, a wash buffer may maintain the pH of the environment at the same level as for the ternary complex. In some embodiments, a wash buffer may raise or lower the pH of the environment relative to the level seen for the ternary complex. In some embodiments, the pH may be within a range from 2-4, 2-7, 5-8, 7-9, 7-10, or lower than 2, or higher than 10, or a range defined by any two of the values provided herein.

Addition of a particular ion may affect the binding of the polymerase to a primed target nucleic acid, the formation of a ternary complex, the dissociation of a ternary complex, or the incorporation of one or more nucleotides into an elongating nucleic acid such as during a polymerase reaction. In some embodiments, relevant anions may comprise chloride, acetate, gluconate, sulfate, phosphate, or the like. In some embodiments, an ion may be included in a binding buffer including one or more acids, bases, or salts, such as $NiCl_2$, $CoCl_2$, $MgCl_2$, $MnCl_2$, $SrCi_2$, $CaCl_2$), $CaSO_4$, $SrCO_3$, $BaCl_2$ or the like. Representative salts, ions, solutions and conditions may be found in Remington: The Science and Practice of Pharmacy, 20th. Edition, Gennaro, A. R., Ed. (2000), which is hereby incorporated by reference in its entirety, and especially with respect to Chapter 17 and related disclosure of salts, ions, salt solutions, and ionic solutions.

The binding between a nucleic acid template molecule and a multivalent molecule can be conducted in the presence of a sequencing polymerase that has been rendered catalytically inactive. In some embodiments, the sequencing polymerase has been rendered catalytically inactive by mutation. In some embodiments, the sequencing polymerase has been rendered catalytically inactive by chemical modification. In some embodiments, the sequencing polymerase has been rendered catalytically inactive by the absence of a necessary substrate, ion, or cofactor. In some embodiments, the sequencing polymerase has been rendered catalytically inactive by the absence of magnesium or manganese ions.

The binding between a nucleic acid template molecule and a multivalent molecule can occur in the presence of a sequencing polymerase wherein the binding solution lacks a catalytic ion such as magnesium or manganese. A catalytic ion can promote polymerase-catalyzed incorporation of a nucleotide or nucleotide unit. Alternatively, the binding between a nucleic acid template molecule and a multivalent molecule can occur in the presence of a sequencing polymerase wherein the binding solution comprises a non-catalytic ion such strontium, barium or calcium. A non-catalytic ion can inhibit polymerase-catalyzed incorporation of a nucleotide or nucleotide unit.

A non-catalytic divalent cation (e.g., strontium or barium) can promote formation of a stable ternary complex having a polymerase bound to a primed nucleic acid template molecule and a multivalent molecule (e.g., fluorescently labeled multivalent molecule), and inhibit polymerase-catalyzed incorporation of the nucleotide unit, where the stable ternary complex has a persistence time that permits detection and imaging by fluorescence detection or by other methods known in the art. Unbound polymer-nucleotide conjugates may optionally be washed away prior to detection of the ternary binding complex.

A catalytic divalent cation (e.g., magnesium or manganese) can promote formation of a stable ternary complex having a polymerase bound to a primed nucleic acid template molecule and a free nucleotide (e.g., fluorescently labeled nucleotide), and promote polymerase-catalyzed incorporation of the nucleotide, where the stable ternary complex has a persistence time that permits detection and imaging by fluorescence detection or by other methods known in the art.

In some embodiments, the sequencing polymerases which can be used with nucleotides and/or multivalent molecules comprise one or more engineered DNA polymerases comprising the amino acid sequence backbone of a family-B or family-A polymerase which typically include replicative polymerases that exhibit high fidelity. Examples of family-B type polymerases include family-B archaeal DNA polymerases and Phi29 polymerase. In some embodiments, engineered DNA polymerases comprise family-B archaeal DNA polymerases which can be selected from *Thermococcus*, *Thermoplasmata*, *Pyrococcus*, Methanococcus, Hadesarchaea, Euryarchaeota, or Candidatus. In some embodiments, engineered DNA polymerases that are family-B polymerases comprise the amino acid sequence backbone from 9° N polymerase (including THERMINATOR polymerase), VENT polymerase, DEEP VENT polymerase, Pfu polymerase or *Pyrococcus abyssi* polymerase. In some embodiments, engineered DNA polymerases that are family-A polymerases comprise the amino acid sequence backbone of *Geobacillus stearothermophilus* (e.g., Bst DNA polymerase).

In some embodiments, the sequencing polymerases which can be used with nucleotides and/or multivalent molecules have been engineered to include at least one substitution mutation, wherein the sequencing polymerases having amino acid sequence backbones of RLF 89458.1 (e.g., from Thermococci archaeon, isolate B13_G1) (SEQ ID NO:1), RLF 78286.1 (e.g., from Thermococci archaeon, isolate B89_G9) (SEQ ID NO:2), NOZ 58130.1 (e.g., from Euryarchaeota archaeon, isolate M_BaxBin.100) (SEQ ID NO:1316), RMF 90817.1 (e.g., from Euryarchaeota archaeon, isolate J060) (SEQ ID NO:2215), MBC 7218772.1 (e.g., from Hadesarchaea archaeon, isolate MAG-18) (SEQ ID NO:2367), WP 175059460.1 (e.g., from *Thermococcus* sp. 2319x1) (SEQ ID NO:2393), KUO 42443.1 (e.g., from Candidatus Hadarchaem, yellowstonense, isolate YNP_45) (SEQ ID NO:2408), and NOZ 77387.1 (e.g., from Euryarchaeota archaeon, isolate M_MaxBin.027) (SEQ ID NO:2436).

In some embodiments, the engineered DNA polymerases which can be used with nucleotides and/or multivalent molecules can be designed and prepared by introducing one or more mutations into the amino acid sequence of a DNA polymerase of interest and the resulting phenotype of the engineered polymerase can be determined. Any one or any combination of two or more mutation sites can be transferred from one type of polymerase to a positionally equivalent site (or functionally equivalent site) in a second type of polymerase. For example, any one or any combination of two or more mutation sites from a DNA polymerase comprising any one of SEQ ID NOS: 3-1315, 1317-2214, 2216-2366, 2368-2392, 2394-2407, 2409-2435, 2437-2454, 2456-2501 or 2511-2523 can be introduced into a positionally equivalent site (or functionally equivalent site) in a *Geobacillus stearothermophilus* (e.g., Bst DNA polymerase) (SEQ ID NO:2502), 9° N polymerase (SEQ ID NOS:2503 or 2504) (including THERMINATOR polymerase; SEQ ID NO:2505), VENT polymerase (SEQ ID NO:2506), DEEP VENT polymerase (SEQ ID NO:2507), Pfu polymerase (SEQ ID NO:2508) and/or *Pyrococcus abyssi* polymerase (SEQ ID NO:2509), RB69 polymerase (SEQ ID NO:2510) or Phi29 (SEQ ID NO:2455). Exemplary sequence alignments are provided in FIGS. 153-160. The mutations include any one or any combination of two or more amino acid substitutions, insertions, deletions and/or truncations.

In some embodiments, the engineered DNA polymerases which can be used with nucleotides and/or multivalent molecules comprise functional equivalents of a residue comprise one or more amino acid residues that occupy a similar position in the sequence (e.g., sequence alignment) and/or three-dimensional structure of an enzyme (e.g., DNA polymerase), and performs substantially the same function as a known amino acid residue in a known enzyme. A functionally equivalent amino acid substitution includes one or more amino acid residues at a particular position in a basis polypeptide that has the same functional role in another polypeptide. A functionally equivalent amino acid substitution includes any one or any combination of conservative and/or non-conservative amino acid substitutions. Sequence alignments are provided in FIGS. 153-159, which list examples of amino acid residues at sites in a DNA polymerase comprising a backbone sequence of any of SEQ ID NOS: 1, 2, 1316, 2215, 2367, 2393, 2408 or 2436, and functionally equivalent amino acid sites in *Geobacillus stearothermophilus* (e.g., Bst DNA polymerase) (SEQ ID NO:2502), 9° N DNA polymerase (relative to SEQ ID NO:2372 or 2373), Pfu DNA polymerase (relative to SEQ ID NO:2508) or *Pyrococcus abyssi* DNA polymerase (relative to SEQ ID NO:2509).

In some embodiments, the engineered DNA polymerases which can be used with nucleotides and/or multivalent molecules exhibit desirable characteristics including exonuclease-minus activity and increased thermal stability compared to a corresponding wild type polymerase, improved uracil-tolerance and/or reduced sequence-specific sequencing errors.

In some embodiments, compared to wild type polymerase, some of the engineered polymerases which can be used with nucleotides and/or multivalent molecules can exhibit one or more desirable characteristics, including increased binding affinity to nucleotide analogs having a 3' chain terminating group, improved ability to incorporate a dATP nucleotide opposite a uracil-containing template molecule (e.g., uracil-tolerant mutant polymerases), improved ability to bind complementary nucleotide units of multivalent molecules, increased thermal stability up to approximately 80° C., and reduced sequence-specific errors.

Embodiments of engineered polymerases which can be used with nucleotides and/or multivalent molecules are listed in Tables 1-15 (FIGS. 138-152, respectively).

In some embodiments, engineered polymerases which can be used with nucleotides and/or multivalent molecules comprise a backbone sequence of RLF 89458.1 and having a sequence that has at least 70%, 75%, 80%, 85%, 90%, 91%, 92%, 93%, 94%, 95%, 96%, 97%, 98%, 99%, or greater than 99% sequence identity to any of SEQ ID NOs:1-1315 and the polypeptide comprises at least one of the mutations listed in Tables 1, 2 and 3 (FIGS. 138, 139 and 140, respectively).

In some embodiments, the engineered polymerases comprise a backbone sequence of RLF 89458.1 (e.g., SEQ ID NO:1) or RLF 78286.1 (SEQ ID NO:2) and comprise at least one amino acid substitution mutation that reduces 3' to 5' exonuclease activity compared to a polymerase that lacks an exo-minus mutation. For example, the mutant polymerases comprise at least one amino acid substitution at positions D141 and/or E143. In some embodiments, the mutant polymerases comprise a mutation D141A, D141V, D141L, D141I, D141F, D141Y, D141N, D141T or D141S. In some embodiments, the mutant polymerases comprise a mutation E143A, E143V, E143L, E143I, E143F, E143Y, E143N, E143T or E143S. In some embodiments, the mutant polymerases comprise any combination of mutations at the D141 and the E143 sites.

In some embodiments, the engineered polymerases comprise a backbone sequence of RLF 89458.1 (e.g., SEQ ID NO:1) or RLF 78286.1 (SEQ ID NO:2) and comprise at least one amino acid substitution mutations of an LYP motif, for example at positions L409, Y410 and P411. In some embodiments, at least one mutation in the LYP motif can increase the incorporation rate of nucleotide analogs. In some embodiments, any one or any combination of the first, second and/or third positions of the LYP motif can be mutated. For example, mutations of the LYP motif include AAG, AAP, AAV, AAI, AGA, AGG, AGI, AGP, AGV, FAA, FAG, FAI, FAP, FAV, FGA, FGG, FGP, FGV, LAG, LAI, LAP, LGG, LGI, LGV, SAA, SAG, SAI, SAV, SGA, SGG, SGI, YAA, YAG, YAI, YAP, YGA, YGG, YGI, YGP, LAA, LAV, LGP, LGA, FGI, SGV, YAV, YGV, SYP, SAP, AAA, SGP, LFP, IFP, VFP, LMP, VMP, IMP, LLP, VLP, ILP, LDP, VDP, IDP, LTP, VTP, ITP, LIP, TIP, NNP, NDP, NAP, SYG and FTA.

Engineered polymerases comprising a backbone sequence of RLF 89458.1 are described in U.S. patent application Nos. 63/311,939 (filed Feb. 18, 2022), 63/343,036 (filed May 17, 2022), and 63/479,490 (filed Jan. 11, 2023), all patent applications entitled 'Engineered Polymerases with Reduced Sequence-Specific Errors', are hereby expressly incorporated by reference in their entireties.

In some embodiments, engineered polymerases which can be used with nucleotides and/or multivalent molecules comprise a backbone sequence of NOZ 58130.1 and having a sequence that has at least 70%, 75%, 80%, 85%, 90%, 91%, 92%, 93%, 94%, 95%, 96%, 97%, 98%, 99%, or greater than 99% sequence identity to any of SEQ ID NOs:1316-2214 and the polypeptide comprises at least one of the mutations listed in Tables 4-6 (FIGS. 141-143, respectively).

In some embodiments, the engineered polymerases comprise a backbone sequence of NOZ 58130.1 (e.g., any of SEQ ID NO:1316-2214) and comprise at least one amino acid substitution mutation that reduces 3' to 5' exonuclease activity compared to a polymerase that lacks an exo-minus mutation. For example, the mutant polymerases comprise at least one amino acid substitution at positions D168 and/or E170. In some embodiments, the mutant polymerases comprise a mutation D168A, D168V, D168L, D168I, D168F, D168Y, D168N, D168T or D168S. In some embodiments, the mutant polymerases comprise a mutation E170A, E170V, E170L, E170I, E170F, E170Y, E170N, E170T or E170S. In some embodiments, the mutant polymerases comprise any combination of mutations at the D168 and the E170 sites.

In some embodiments, the engineered polymerases comprise a backbone sequence of NOZ 58130.1 (e.g., any of SEQ ID NO:1316-2214) and comprise at least one amino acid substitution mutations of an LYP motif, for example at positions L440, Y441 and P442. In some embodiments, at least one mutation in the LYP motif can increase the incorporation rate of nucleotide analogs. In some embodiments, any one or any combination of the first, second and/or third positions of the LYP motif can be mutated. For example, mutations of the LYP motif include YAG, FAG, YGP, YAP, FGP, SAP, AAA, YGA, YAA, FGA, FTA, AAG, AAP, AAV, AAI, AGA, AGG, AGI, AGP, AGV, FAA, FAI, FAP, FAV, FGG, FGV, LAG, LAI, LAP, LGG, LGI, LGV, SAA, SAG, SAL, SAV, SGA, SGG, SGI, YAI, YGG, YGI, LAA, LAV, LGP, LGA, FGI, SGV, YAV, YGV, SYP, SGP, LFP, IFP, VFP, LMP, VMP, IMP, LLP, VLP, ILP, LDP, VDP, IDP, LTP, VTP, ITP, LIP, TIP, NNP, NDP, NAP and SYG.

Engineered polymerases comprising a backbone sequence of NOZ 58130.1 are described in U.S. patent application Nos. 63/311,939 (filed Feb. 18, 2022), 63/343,036 (filed May 17, 2022), and 63/479,490 (filed Jan. 11, 2023), all patent applications entitled 'Engineered Polymerases with Reduced Sequence-Specific Errors', are hereby expressly incorporated by reference in their entireties.

In some embodiments, engineered polymerases which can be used with nucleotides and/or multivalent molecules comprise a backbone sequence of RMF 90817.1 and having a sequence that has at least 70%, 75%, 80%, 85%, 90%, 91%, 92%, 93%, 94%, 95%, 96%, 97%, 98%, 99%, or greater than 99% sequence identity to any of SEQ ID NOs:2215-2366 and the polypeptide comprises at least one of the mutations listed in Tables 7 and 8 (FIGS. 144 and 145, respectively).

In some embodiments, the engineered polymerases comprise a backbone sequence of RMF 90817.1 (e.g., SEQ ID NO:2215) and comprise at least one amino acid substitution mutation that reduces 3' to 5' exonuclease activity compared to a polymerase that lacks an exo-minus mutation. For example, the mutant polymerases comprise at least one amino acid substitution at positions D149 and/or E151. In some embodiments, the mutant polymerases comprise a mutation D149A, D149V, D149L, D1491, D149F, D149Y, D149N, D149T or D149S. In some embodiments, the mutant polymerases comprise a mutation E151A, E151V, E151L, E151I, E511F, E151Y, E151N, E151T or E151S. In some embodiments, the mutant polymerases comprise any combination of mutations at the D149 and the E151 sites.

In some embodiments, the engineered polymerases comprise a backbone sequence of RMF 90817.1 (e.g., SEQ ID NO:2215) and comprise at least one amino acid substitution mutations of an LYP motif, for example at positions L421, Y422 and P423. In some embodiments, at least one mutation in the LYP motif can increase the incorporation rate of nucleotide analogs. In some embodiments, any one or any combination of the first, second and/or third positions of the LYP motif can be mutated. For example, mutations of the LYP motif include AAA, AAG, AGA, AGP, FAA, FAG, FGA, FGP, SAA, SAG, SGA, SGP, YAA, YAG, YGA, YGP, FAP, SAP, YAP, AAP, AGV, AGG, AGI, AAV, AAI, FAI, FTA, FAV, FGG, FGV, LAG, LAI, LAP, LGG, LGI, LGV, SAI, SAV, SGG, SGI, YAI, YGG, YGI, LAA, LAV, LGP, LGA, FGI, SGV, YAV, YGV, SYP, LFP, IFP, VFP, LMP, VMP, IMP, LLP, VLP, ILP, LDP, VDP, IDP, LTP, VTP, ITP, LIP, TIP, NNP, NDP, NAP and SYG.

Engineered polymerases comprising a backbone sequence of RMF 90817.1 are described in U.S. patent application Nos. 63/311,939 (filed Feb. 18, 2022), 63/343,036 (filed May 17, 2022), and 63/479,490 (filed Jan. 11, 2023), all patent applications entitled 'Engineered Polymerases with Reduced Sequence-Specific Errors', are hereby expressly incorporated by reference in their entireties.

In some embodiments, engineered polymerases which can be used with nucleotides and/or multivalent molecules comprise a backbone sequence of MBC 7218772.1 and having a sequence that has at least 70%, 75%, 80%, 85%, 90%, 91%, 92%, 93%, 94%, 95%, 96%, 97%, 98%, 99%, or greater than 99% sequence identity to any of SEQ ID NOs:23672392 and the polypeptide comprises at least one of the mutations listed in Tables 9 and 10 (FIGS. 146 and 147, respectively).

In some embodiments, the engineered polymerases comprise a backbone sequence of MBC 7218772.1 (e.g., SEQ ID NO:2367) and comprise at least one amino acid substitution mutation that reduces 3' to 5' exonuclease activity compared to a polymerase that lacks an exo-minus mutation. For example, the mutant polymerases comprise at least one amino acid substitution at positions D173 and/or E175. In some embodiments, the mutant polymerases comprise a mutation D173A, D173V, D173L, D173I, D173F, D173Y, D173N, D173T or D173S. In some embodiments, the mutant polymerases comprise a mutation E175A, E175V, E175L, E175I, E175F, E175Y, E175N, E175T or E175S. In some embodiments, the mutant polymerases comprise any combination of mutations at the D173 and the E175 sites.

In some embodiments, the engineered polymerases comprise a backbone sequence of MBC 7218772.1 (e.g., SEQ ID NO:2367) and comprise at least one amino acid substitution mutations of an LYP motif, for example at positions L451, Y452 and P453. In some embodiments, at least one mutation in the LYP motif can increase the incorporation rate of nucleotide analogs. In some embodiments, any one or any combination of the first, second and/or third positions of the LYP motif can be mutated. For example, mutations of the LYP motif include AAA, AAG, AGA, AGP, FAA, FAG, FGA, FGP, SAA, SAG, SGA, SGP, YAA, YAG, YGA, YGP, FAP, SAP, YAP, AAP, LAP, AGV, AGG, AGI, AAV, AAI, FAI, FTA, FAV, FGG, FGV, LAG, LAI, LGG, LGI, LGV, SAL, SAV, SGG, SGI, YAI, YGG, YGI, LAA, LAV, LGP, LGA, FGI, SGV, YAV, YGV, SYP, LFP, IFP, VFP, LMP, VMP, IMP, LLP, VLP, ILP, LDP, VDP, IDP, LTP, VTP, ITP, LIP, TIP, NNP, NDP, NAP and SYG.

Engineered polymerases comprising a backbone sequence of MBC 7218772.1 are described in U.S. patent application Nos. 63/311,939 (filed Feb. 18, 2022), 63/343,036 (filed May 17, 2022), and 63/479,490 (filed Jan. 11, 2023), all patent applications entitled 'Engineered Polymerases with Reduced Sequence-Specific Errors', are hereby expressly incorporated by reference in their entireties.

In some embodiments, engineered polymerases which can be used with nucleotides and/or multivalent molecules comprise a backbone sequence of WP 175059460.1 and having a sequence that has at least 70%, 75%, 80%, 85%, 90%, 91%, 92%, 93%, 94%, 95%, 96%, 97%, 98%, 99%, or greater than 99% sequence identity to any of SEQ ID NOs:2393-2407 and 2511-2523 and the polypeptide comprises at least one of the mutations listed in Table 11 (FIG. 148).

In some embodiments, the engineered polymerases comprise a backbone sequence of WP 175059460.1 (e.g., SEQ ID NO:2393) and comprise at least one amino acid substitution mutation that reduces 3' to 5' exonuclease activity compared to a polymerase that lacks an exo-minus mutation. For example, the mutant polymerases comprise at least one amino acid substitution at positions D141 and/or E143. In some embodiments, the mutant polymerases comprise a mutation D141A, D141V, D141L, D141I, D141F, D141Y, D141N, D141T or D141S. In some embodiments, the mutant polymerases comprise a mutation E143A, E143V, E143L, E1431, E143F, E143Y, E143N, E143T or E143S. In some embodiments, the mutant polymerases comprise any combination of mutations at the D141 and the E143 sites.

In some embodiments, the engineered polymerases comprise a backbone sequence of WP 175059460.1 (e.g., SEQ ID NO:2393) and comprise at least one amino acid substitution mutations of an LYP motif, for example at positions L451, Y452 and P453. In some embodiments, at least one mutation in the LYP motif can increase the incorporation rate of nucleotide analogs. In some embodiments, any one or any combination of the first, second and/or third positions of the LYP motif can be mutated. For example, mutations of the LYP motif include AAA, AAG, AGA, AGP, FAA, FAG, FGA, FGP, SAA, SAG, SGA, SGP, YAA, YAG, YGA, YGP, FAP, SAP, YAP, AAP, LAP, AGV, AGG, AGI, AAV, AAI, FAI, FTA, FAV, FGG, FGV, LAG, LAI, LGG, LGI, LGV, SAL, SAV, SGG, SGI, YAI, YGG, YGI, LAA, LAV, LGP, LGA, FGI, SGV, YAV, YGV, SYP, LFP, IFP, VFP, LMP, VMP, IMP, LLP, VLP, ILP, LDP, VDP, IDP, LTP, VTP, ITP, LIP, TIP, NNP, NDP, NAP and SYG.

Engineered polymerases comprising a backbone sequence of WP 175059460.1 are described in U.S. patent application Nos. 63/311,939 (filed Feb. 18, 2022), 63/343,036 (filed May 17, 2022), and 63/479,490 (filed Jan. 11, 2023), all patent applications entitled 'Engineered Polymerases with Reduced Sequence-Specific Errors', are hereby expressly incorporated by reference in their entireties.

In some embodiments, engineered polymerases which can be used with nucleotides and/or multivalent molecules comprise a backbone sequence of KUO 42443.1 and having a sequence that has at least 70%, 75%, 80%, 85%, 90%, 91%, 92%, 93%, 94%, 95%, 96%, 97%, 98%, 99%, or greater than 99% sequence identity to any of SEQ ID NOs:2408-2435 and the polypeptide comprises at least one of the mutations listed in Tables 12 and 13 (FIGS. 149 and 150, respectively).

In some embodiments, the engineered polymerases comprise a backbone sequence of KUO 42443.1 (e.g., SEQ ID NO:2408) and comprise at least one amino acid substitution mutation that reduces 3' to 5' exonuclease activity compared to a polymerase that lacks an exo-minus mutation. For example, the mutant polymerases comprise at least one amino acid substitution at positions D170 and/or E172. In some embodiments, the mutant polymerases comprise a mutation D170A, D170V, D170L, D170I, D170F, D170Y, D170N, D170T or D170S. In some embodiments, the mutant polymerases comprise a mutation E172A, E172V, E172L, E172I, E172F, E172Y, E172N, E172T or E172S. In some embodiments, the mutant polymerases comprise any combination of mutations at the D170 and the E172 sites.

In some embodiments, the engineered polymerases comprise a backbone sequence of KUO 42443.1 (e.g., SEQ ID NO:2408) and comprise at least one amino acid substitution mutations of an LYP motif, for example at positions L448, Y449 and P450. In some embodiments, at least one mutation in the LYP motif can increase the incorporation rate of nucleotide analogs. In some embodiments, any one or any combination of the first, second and/or third positions of the LYP motif can be mutated. For example, mutations of the LYP motif include AAA, SAG, SGP, SAP, LAP, AAG, AGA, AGP, FAA, FAG, FGA, FGP, SAA, SGA, YAG, YGA, YGP, FAP, YAP, AAP, YAA, AGV, AGG, AGI, AAV, AAI, FAI, FTA, FAV, FGG, FGV, LAG, LAI, LGG, LGI, LGV, SAI, SAV, SGG, SGI, YAI, YGG, YGI, LAA, LAV, LGP, LGA, FGI, SGV, YAV, YGV, SYP, LFP, IFP, VFP, LMP, VMP, IMP, LLP, VLP, ILP, LDP, VDP, IDP, LTP, VTP, ITP, LIP, TIP, NNP, NDP, NAP and SYG.

Engineered polymerases comprising a backbone sequence of KUO 42443.1 are described in U.S. patent application Nos. 63/311,939 (filed Feb. 18, 2022), 63/343,036 (filed May 17, 2022), and 63/479,490 (filed Jan. 11, 2023), all patent applications entitled 'Engineered Polymerases with Reduced Sequence-Specific Errors', are hereby expressly incorporated by reference in their entireties.

In some embodiments, engineered polymerases which can be used with nucleotides and/or multivalent molecules comprise a backbone sequence of NOZ 77387.1 and having a sequence that has at least 70%, 75%, 80%, 85%, 90%, 91%, 92%, 93%, 94%, 95%, 96%, 97%, 98%, 99%, or greater than 99% sequence identity to any of SEQ ID NOs:2436-2454 and the polypeptide comprises at least one of the mutations listed in Table 14 (FIG. 151).

In some embodiments, the engineered polymerases comprise a backbone sequence of NOZ 77387.1 (e.g., SEQ ID NO:2436) and comprise at least one amino acid substitution mutation that reduces 3' to 5' exonuclease activity compared to a polymerase that lacks an exo-minus mutation. For example, the mutant polymerases comprise at least one amino acid substitution at positions D161 and/or E163. In some embodiments, the mutant polymerases comprise a mutation D161A, D161V, D161L, D161I, D161F, D161Y, D161N, D161T or D161S. In some embodiments, the mutant polymerases comprise a mutation E163A, E163V, E163L, E163I, E163F, E163Y, E163N, E163T or E163S. In some embodiments, the mutant polymerases comprise any combination of mutations at the D161 and the E163 sites.

In some embodiments, the engineered polymerases comprise a backbone sequence of NOZ 77387.1 (e.g., SEQ ID NO:2436) and comprise at least one amino acid substitution mutations of an LYP motif, for example at positions L448, Y449 and P450. In some embodiments, at least one mutation in the LYP motif can increase the incorporation rate of nucleotide analogs. In some embodiments, any one or any combination of the first, second and/or third positions of the LYP motif can be mutated. For example, mutations of the LYP motif include AAA, SAP, FAG, FGP, YAG, YGP, FAP, YAP, SAG, SGP, LAP, AAG, AGA, AGP, FAA, FGA, SAA, SGA, YGA, AAP, YAA, AGV, AGG, AGI, AAV, AAI, FAI, FTA, FAV, FGG, FGV, LAG, LAI, LGG, LGI, LGV, SAI, SAV, SGG, SGI, YAI, YGG, YGI, LAA, LAV, LGP, LGA, FGI, SGV, YAV, YGV, SYP, LFP, IFP, VFP, LMP, VMP, IMP, LLP, VLP, ILP, LDP, VDP, IDP, LTP, VTP, ITP, LIP, TIP, NNP, NDP, NAP and SYG.

Engineered polymerases comprising a backbone sequence of NOZ 77387.1 are described in U.S. patent application Nos. 63/311,939 (filed Feb. 18, 2022), 63/343,036 (filed May 17, 2022), and 63/479,490 (filed Jan. 11, 2023), all patent applications entitled 'Engineered Polymerases with Reduced Sequence-Specific Errors', are hereby expressly incorporated by reference in their entireties.

In some embodiments, engineered polymerases which can be used with nucleotides and/or multivalent molecules comprise a backbone sequence of Phi29 and having a sequence that has at least 70%, 75%, 80%, 85%, 90%, 91%, 92%, 93%, 94%, 95%, 96%, 97%, 98%, 99/a, or greater than 99% sequence identity to any of SEQ ID NOs:2455-2501 and the polypeptide comprises at least one of the mutations listed in Table 15 (FIG. 152). Engineered polymerases comprising a backbone sequence of Phi29 are described in U.S. patent application Nos. 63/311,939 (filed Feb. 18, 2022), 63/343,036 (filed May 17, 2022), and 63/479,490 (filed Jan. 11, 2023), all patent applications entitled 'Engineered Polymerases with Reduced Sequence-Specific Errors', are hereby expressly incorporated by reference in their entireties.

Cleaving Reagents

The present disclosure provides compositions and methods for pairwise sequencing, including methods for cleaving/removing a chain terminator moiety from an incorporated terminal nucleotide on a nascent strand during a sequencing workflow. For example, the incorporated terminal nucleotide comprises a chain terminator moiety linked to the 3' sugar position by a cleavable linker. In some embodiments, the cleavable linker can be cleaved using a cleaving reagent.

The present disclosure also provides compositions and methods for pairwise sequencing, including methods for cleaving/removing a detectable reporter moiety (e.g., a fluorophore) from an incorporated nucleotide on a nascent strand during a sequencing workflow. For example, the incorporated nucleotide comprises a fluorophore linked to the nucleo-base. In some embodiments, the linker that attaches the fluorophore to the nucleo-base is cleavable under the same condition that will cleave the cleavable linker at the 3' sugar position.

The present disclosure also provides compositions and methods for pairwise sequencing, including methods for cleaving/removing a chain terminator moiety from a multivalent molecule that is bound and/or unbound to a complexed polymerase using a cleaving reagent under a condition suitable for cleaving the chain terminator moiety from the nucleotide units of the multivalent molecule.

The present disclosure also provides compositions and methods for pairwise sequencing, including methods for cleaving/removing a detectable reporter moiety (e.g., fluorophore) from a multivalent molecule that is bound and/or unbound to a complexed polymerase using a cleaving reagent under a condition suitable for cleaving the detectable reporter moiety from the nucleotide units of the multivalent molecule.

In some embodiments, the cleaving reagent comprises at least one cleaving compound that cleaves the linker that attaches the fluorophore to the nucleotide or to the nucleotide unit of a multivalent molecule.

In some embodiments, the cleaving reagent comprises at least one cleaving compound that cleaves the linker that attaches the chain terminator moiety to the nucleotide or to the nucleotide unit.

In some embodiments, the cleaving compound comprises piperidine, 2,3-Dichloro-5,6-dicyano-1,4-benzo-quinone (DDQ), or tetrakis(triphenylphosphine)palladium(0) (Pd (PPh$_3$)$_4$), with piperidine.

In some embodiment, the cleaving compound comprises a palladium catalyst, for example palladium-on-carbon (Pd/C).

In some embodiments, the cleaving compound comprises beta-mercaptoethanol or dithiothritol (DTT).

In some embodiments, the cleaving compound comprise potassium carbonate (K$_2$CO$_3$) in MeOH, triethylamine in pyridine, or Zn in acetic acid (AcOH).

In some embodiments, the cleaving compound comprises tetrabutylammonium fluoride, pyridine-HF, ammonium fluoride, or triethylamine trihydrofluoride.

In some embodiments, the cleaving compound comprises a phosphine compound, including for example a phosphine having a derivatized tri-alkyl phosphine moiety or a derivatized tri-aryl phosphine moiety. In some embodiments, the phosphine cleaving compound comprises Tris(2-carboxyethyl)phosphine (TCEP) or bis-sulfo triphenyl phosphine (BS-TPP). In some embodiments, the phosphine cleaving compound comprises Tri(hydroxyproyl)phosphine (THPP) or Tris(hydroxymethyl)phosphine (THMP) or 4-dimethylaminopyridine (4-DMAP).

In some embodiments, the cleaving catalyst comprises 4-dimethylaminopyridine (4-DMAP).

The cleaving reagents can include a cleaving compound and/or a cleaving catalyst at a concentration of about 1-10 mM, or about 10-25 mM, or about 25-50 mM, or about 50-75 mM, or about 75-100 mM.

In some embodiments, the cleaving reagent can include a pH buffering agent. The pH buffering agent comprises any one or any combination of two or more of Tris, Tris-HCl, Tricine, Bicine, Bis-Tris propane, HEPES, MES, MOPS, MOPSO, BES, TES, CAPS, TAPS, TAPSO, ACES, PIPES, ethanolamine (a.k.a 2-amino methanol; MEA), a citrate compound, a citrate mixture, NaOH and/or KOH. In some embodiments, the pH buffering agent can be present in cleaving reagent at a concentration of about 1-100 mM, or about 10-50 mM, or about 10-25 mM. In some embodiments, the pH of the pH buffering agent which is present in the cleaving reagent can be adjusted to a pH of about 4-9.5, or a pH of about 5-9.5, or a pH of about 6-8.5.

In some embodiments, the cleaving reagent can include a monovalent cation which comprises sodium or potassium. In some embodiments, the monovalent cation is in the form of MgCl$_2$ or NaCl. In some embodiments, the cleaving reagent comprises MgCl$_2$ at a concentration of about 1-10 mM, or about 10-20 mM, or about 10-50 mM. In some embodiments, the cleaving reagent comprises NaCl at a concentration of about 25-200 mM, or about 50-150 mM.

In some embodiments, cleaving reagent can include a detergent. In some embodiments, the detergent comprises an ionic detergent such as SDS (sodium dodecyl sulfate). In some embodiments, the detergent comprises a non-ionic detergent such as Triton X-100, Tween 20, Tween 80 or Nonidet P-40. In some embodiments, the detergent comprises a zwitterionic detergent such as CHAPS (3-[(3-cholamidopropyl)dimethylammonio]-1-propanesulfonate) or N-Dodecyl-N,N-dimethyl-3-amonio-1-propanesulfate (DetX). In some embodiments, the detergent comprises LDS (lithium dodecyl sulfate), sodium taurodeoxycholate, sodium taurocholate, sodium glycocholate, sodium deoxycholate or sodium cholate. In some embodiments, the detergent is included in a cleaving reagent at a concentration of about 0.01-0.05%, or about 0.05-0.1%, or about 0.1-0.15%, or about 0.15-0.2%, or about 0.2-0.25%.

Cleaving Reagents with Compounds to Reduce Photo-Damage

The various pairwise sequencing workflows described herein generally include conducting a forward sequencing reaction to generate a plurality of extended forward sequencing primer strands, and conducting a reverse sequencing reaction to generate a plurality of extended reverse sequencing primer strands. The forward and reverse sequencing reactions can be conducted using fluorescently-labeled nucleotides, or using fluorescently-labeled multivalent molecules and nucleotides (labeled and/or unlabeled nucleotide). Detection and identification of the fluorescently-labeled nucleotides and the fluorescently-labeled multivalent molecules during a forward and reverse sequencing reactions yields forward reads (e.g., R1 reads) and reverse reads (e.g., R2 reads), respectively. The detection step includes exciting the fluorophores with radiation energy (e.g., light) and emission of a fluorescent signal from the fluorophores. Typically, high intensity fluorescent signals during the forward and reverse reads increase sequencing accuracy, while low intensity signal negatively impact the accuracy of the forward and reverse reads. Ideally, the intensity of the forward and reverse reads are similar to each other, and are not affected by the read length (e.g., number of sequencing cycles) of the forward sequencing reads. In a non-ideal situation, the intensity of the reverse sequencing reads (R2 reads) drops when the number of forward sequencing reads increases. Without wishing to be bound to theory, it is postulated that a decrease in signal intensity of the reverse sequencing reads when the forward sequencing reads are long (e.g., longer than 5-10 sequencing cycles) is caused by photo damage to the immobilized concatemer template molecules and/or the retained forward extension strand. When the cleaving reagent includes at least one compound that reduces photo-damage to the nucleic acids, the signal intensity of the reverse sequencing reads increases even for long forward sequencing reads (e.g., see FIG. 119).

The present disclosure provides cleaving reagents comprising: at least one solvent; a pH buffering agent; at least one monovalent cation; a detergent; a cleaving compound and/or a cleaving catalyst; and at least one or any combination of two or more compounds that can reduce photo-damage, including antioxidants, triplet state quenchers, singlet oxygen quenchers, oxygen scavengers, electron scavengers, anti-fade formulations. The skilled artisan will appreciate that some of these compounds can be classified as more than one type of photo-damage reducing compound.

In some embodiments, the cleaving reagent can include at least one antioxidant, including ascorbic acid, ascorbyl palmitate, D-isoascorbic acid (erythorbic acid), sodium ascorbate, butylated hydroxytoluene (BTH), butylated hydroxy toluene (BHT), polyphenol antioxidants, polyvinyl alcohols, butylated hydroxy anisol (BHA) or Trolox (6-hydroxy-2,5,7,8-tetramethylchroman-2-carboxylic acid) or other vitamin E analogs including nitrated Trolox derivates (see U.S. Pat. No. 9,994,541, the entire contents of which are expressly incorporated by reference in its entirety).

In some embodiments, the cleaving reagent can include at least one triplet state quenchers including ascorbic acid, 1,4-diazobicyclo[2.2.2]octane (DABCO), cyclo-octatetraene (COT), dithiothreitol (DTT), mercaptoethylamine (MEA), β-mercaptoethanol (BME), n-propyl gallate, p-phenylenediamene (PPD), hydroquinone and sodium azide (NaN$_3$), TEMPO (2,2,6,6-tetramethyl1-1-piperidinyloxyl), HTEMPO (4-hydroxy derivative of TEMPO) and/or DTBN (di-t-butylnitroxide).

In some embodiments, the cleaving compound can include at least one singlet oxygen quenchers including thiol-based quenchers such as glutathione, dithiothreitol, ergothioneine, methionine, cysteine, beta-dimethyl cysteine (penicillamine), mercaptopropionylglycine, MESNA, imidazole, and/or N-acetyl cysteine and captopril.

In some embodiments, the cleaving compound can include at least one oxygen scavenger including glutathione, and N-acetylcysteine, histidine, tryptophan, hydrazine (N$_2$H$_4$), sodium sulfite (Na$_2$SO$_3$) and/or hydroxylamine.

In some embodiments, the cleaving compound can include at least one electron scavenger including methyl viologen (e.g., 1,1'-dimethyl-4,4'-bipyridinium dichloride).

In some embodiments, the cleaving compound can include at least one anti-fade formulation including commercially-available products including Fluoroguard Antifade Reagent (e.g., from BioRad), SlowFade Antifade Kit (e.g., includes DABCO, from Molecular Probes-Invitrogen), ProLong Gold Antifade Reagent (e.g., from Invitrogen), and/or CitiFluor (e.g., from CitiFluor).

The cleaving reagent can include at least one of the compounds that reduce photo damage at a concentration of about 0.1-1 mM, or about 1-10 mM, or about 10-25 mM, or about 25-50 mM, or about 50-75 mM, or about 75-100 mM.

High Efficiency Hybridization Buffers

The present disclosure provides pairwise sequencing compositions and methods which employ a high efficiency hybridization buffer. The high efficiency hybridization buffer can be used to hybridize soluble forward sequencing primers (e.g., second plurality of forward sequencing primers) to the retained immobilized concatemer template molecules. The high efficiency hybridization buffer can be used to hybridize soluble reverse sequencing primers to the retained forward extension strands.

The high efficiency hybridization buffers described herein promote high stringency (e.g., specificity), speed, and efficacy of nucleic acid hybridization reactions and increases the efficiency of the subsequent amplification and sequencing steps. The high efficiency hybridization buffers can significantly shorten nucleic acid hybridization times, and decreases sample input requirements. The high efficiency hybridization buffers can be used for nucleic acid annealing workflows at isothermal conditions which eliminates requirement of a cooling step for annealing.

In some embodiments, the high efficiency hybridization buffer comprises a first and second polar aprotic solvent, a pH buffer system and a crowding agent. The polar solvent can be a solvent or solvent system comprising one or more molecules characterized by the presence of a permanent dipole moment, i.e., a molecule having a spatially unequal distribution of charge density. A polar solvent may be characterized by a dielectric constant of 20, 25, 30, 35, 40, 45, 50, 55, 60 or by a value or a range of values having any of the aforementioned values. A polar solvent may comprise a polar aprotic solvent. A polar aprotic solvent may further contain no ionizable hydrogen in the molecule. In addition, polar solvents or polar aprotic solvents may be preferably substituted in the context of the presently disclosed compositions with a strong polarizing functional groups such as nitrile, carbonyl, thiol, lactone, sulfone, sulfite, and carbonate groups so that the underlying solvent molecules have a dipole moment. Polar solvents and polar aprotic solvents can be present in both aliphatic and aromatic or cyclic form. In some embodiments, the polar solvent is acetonitrile.

In some embodiments, the polar or polar aprotic solvent can have a dielectric constant that is the same as or close to acetonitrile. The dielectric constant of the polar or polar aprotic solvent can be in the range of about 20-60, about 25-55, about 25-50, about 25-45, about 25-40, about 30-50, about 30-45, or about 30-40. The dielectric constant of the polar or polar aprotic solvent can be greater than 20, 25, 30, 35, or 40. The dielectric constant of the polar or polar aprotic solvent can be lower than 30, 40, 45, 50, 55, or 60. The dielectric constant of the polar or polar aprotic solvent can be about 35, 36, 37, 38, or 39.

In some embodiments, the polar or polar aprotic solvent described herein can have a polarity index that is the same as or close to acetonitrile. The polarity index of the polar or polar aprotic solvent can be in the range of about 2-9, 2-8, 2-7, 2-6, 3-9, 3-8, 3-7, 3-6, 4-9, 4-8, 4-7, or 4-6. The polarity index of the polar or polar aprotic solvent can be greater than about 2, 3, 4, 4.5, 5, 5.5, or 6. The polarity index of the polar or polar aprotic solvent can be lower than about 4.5, 5, 5.5, 6, 6.5, 7, 7.5, 8, 8.5, 9, or 10. The polarity index of the polar or polar aprotic solvent can be about 5.5, 5.6, 5.7, or 5.8.

Some examples of the polar or polar aprotic solvent include but are not limited to acetonitrile, dimethylformamide (DMF), dimethylsulfoxide (DMSO), acetanilide, N-acetyl pyrrolidone, 4-amino pyridine, benzamide, benzimidazole, 1,2,3-benzotriazole, butadienedioxide, 2,3-butylene carbonate, γ-butyrolactone, caprolactone (epsilon), chloro maleic anhydride, 2-chlorocyclohexanone, chloroethylene carbonate, chloronitromethane, citraconic anhydride, crotonlactone, 5-cyano-2-thiouracil, cyclopropylnitrile, dimethyl sulfate, dimethyl sulfone, 1,3-dimethyl-5-tetrazole, 1,5-dimethyl tetrazole, 1,2-dinitrobenzene, 2,4-dinitrotoluene, dipheynyl sulfone, 1,2-dinitrobenzene, 2,4-dinitrotoluene, dipheynyl sulfone, epsilon-caprolactam, ethanesulfonylchloride, ethyl ethyl phosphinate, N-ethyl tetrazole, ethylene carbonate, ethylene trithiocarbonate, ethylene glycol sulfate, ethylene glycol sulfite, furfural, 2-furonitrile, 2-imidazole, isatin, isoxazole, malononitrile, 4-methoxy benzonitrile, I-methoxy-2-nitrobenzene, methyl alpha bromo tetronate, 1-methyl imidazole, N-methyl imidazole, 3-methyl isoxazole, N-methyl morpholine-N-oxide, methyl phenyl sulfone, N-methyl pyrrolidinone, methyl sulfolane, methyl-4-toluenesulfonate, 3-nitroaniline, nitrobenzimidazole, 2-nitrofuran, l-nitroso-2-pyrolidinone, 2-nitrothiophene, 2-oxazolidinone, 9,10-phenanthrenequinone, N-phenyl sydnone, phthalic anhydride, picolinonitrile (2-cyanopyridine), 1,3-propane sultone, 0-propiolactone, propylene carbonate, 4H-pyran-4-thione, 4H-pyran-4-one (7-pyrone), pyridazine, 2-pyrrolidone, saccharin, succinonitrile, sulfanilamide, sulfolane, 2,2,6,6-tetrachlorocyclohexanone, tetrahydrothiapyran oxide, tetramethylene sulfone (sulfolane), thiazole, 2-thiouracil, 3,3,3-trichloro propene, 1,1,2-trichloro propene, 1,2,3-trichloro propene, trimethylene sulfide-dioxide, and trimethylene sulfite.

In some embodiments, the high efficiency hybridization buffer includes an amount of the polar solvent or polar aprotic solvent in an amount effective to denature a double stranded nucleic acid. In some embodiments, the amount of the polar or polar aprotic solvent is greater than about 10% by volume based on the total volume of the formulation. The amount of the polar or polar aprotic solvent is about or more than about 5%, 10%, 15%, 20%, 25%, 30%, 35%, 40%, 50%, 60%, 70%, 80%, 90%, or higher, by volume based on the total volume of the formulation. The amount of the polar or polar aprotic solvent is lower than about 15%, 20%, 25%, 30%, 35%, 40%, 50%, 60%, 70%, 80%, 90%, or higher, by volume based on the total volume of the formulation. In some embodiments, the amount of the polar or polar aprotic solvent is in the range of about 10% to 90% by volume based on the total volume of the formulation. In some embodiments, the amount of the polar or polar aprotic solvent is in the range of about 25% to 75% by volume based on the total volume of the formulation. In some embodiments, the amount of the polar or polar aprotic solvent is in the range of about 10% to 95%, 10% to 85%, 20% to 90%, 20% to 80%, 20% to 75%, or 30% to 60% by volume based on the total volume of the formulation.

In some embodiments, the high efficiency hybridization buffer may include an organic solvent. Examples of suitable solvents include, but are not limited to, acetonitrile, ethanol, DMF, and methanol, or any combination thereof at varying percentages (typically >5%). In some embodiments, the percentage of organic solvent (by volume) included in the high efficiency hybridization buffer may range from about 1% to about 20%. In some embodiments, the percentage by volume of organic solvent may be at least 1%, at least 2%, at least 3%, at least 4%, at least 5%, at least 6%, at least 7%, at least 8%, at least 9%, at least 10%, at least 15%, or at least 20%. In some embodiments, the percentage by volume of organic solvent may be at most 20%, at most 15%, at most 10%, at most 9%, at most 8%, at most 7%, at most 6%, at most 5%, at most 4%, at most 3%, at most 2%, or at most 1%. Any of the lower and upper values described in this paragraph may be combined to form a range included within the present disclosure, for example, the percentage by volume of organic solvent may range from about 4% to about 15%. Those of skill in the art will recognize that the percentage by volume of organic solvent may have any value within this range, e.g., about 7.5%.

In some embodiments, the use of a high efficiency hybridization buffer can improve nucleic acid hybridization rates. When a high efficiency hybridization buffer is used in combination with a support having a low non-specific binding coating, the relative hybridization rates may improve and can range from about 2× to about 20× faster than that for a conventional hybridization protocol using a conventional hybridization buffer with a support having a conventional coating. In some embodiments, the use of a high efficiency hybridization buffer can improve the relative hybridization rates of nucleic acid by at least 2×, at least 3×, at least 4×, at least 5×, at least 6×, at least 7×, at least 8×, at least 9×, at least 10×, at least 12×, at least 14×, at least 16×, at least 18×, or at least 20×, compared to that for a conventional hybridization buffer protocol.

Improvements in hybridization efficiency (or yield) is a measure of the percentage of total available tethered adaptor sequences (e.g., surface primers) on a solid surface, primer sequences, or oligonucleotide sequences in general that are hybridized to complementary sequences. In some embodiments, the use of a high efficiency hybridization buffer (optionally, used in combination with low non-specific binding surface) yield improved hybridization efficiency compared to that for a conventional hybridization protocol. In some embodiments, the hybridization efficiency that may be achieved is better than 80%, 85%, 90%, 95%, 98%, or 99% in any of the hybridization reaction times specified above.

Improvements in hybridization specificity is a measure of the ability of tethered adapter sequences (e.g., surface primers), primer sequences, or oligonucleotide sequences in general to correctly hybridize selectively to complementary sequences. In some embodiments, the use of a high efficiency hybridization buffer (optionally, used in combination with low non-specific binding surface) yield improved hybridization specificity compared to that for a conventional hybridization protocol. In some embodiments, the hybridization specificity that may be achieved is better than 1 base mismatch in 10 hybridization events, 1 base mismatch in 100 hybridization events, 1 base mismatch in 1,000 hybridization events, or 1 base mismatch in 10,000 hybridization events.

The term "crowding agent" and related terms refers to a compound that alters the properties of other molecules in a solution. Crowding agents typically have high molecular weight and/or bulky structures. Crowding agents in solution can increase the concentration of other molecules in the solution. Crowding agents can reduce the volume of solvent that is available for other molecules in the solution which can create a molecular crowding environment. Crowding agents in a solution can generate a crowded environment for molecules in the solution. Crowding agents can alter the rates or equilibrium constants of a reaction. Examples of crowding agents include polyethylene glycol (e.g., PEG), ficoll, dextran, glycogen, polyvinyl alcohol, triblock polymers (e.g., Pluronics), polystyrene, polyvinylpyrrolidone (PVP), hydroxypropyl methyl cellulose (HPMC), hydroxyethyl methyl cellulose (HEMC), hydroxybutyl methyl cellulose, hydroxypropyl cellulose, methycellulose, and hydroxyl methyl cellulose. In some embodiments, the crowding agent comprises linear or branched polyethylene glycol (PEG). In some embodiments, the crowding agent comprise PEG 400, PEG 1500, PEG 2000, PEG 3400, PEG 3350, PEG 4000, PEG 6000 or PEG 8000. In some embodiments, a high efficiency hybridization buffer can include at least one crowding agent at about 1%, 2%, 3%, 5%, 10%, 15%, 20%, 25%, 30%, 35%, 40%, 50%, 60%, or higher percent based on volume of the solution. In some embodiments, high efficiency hybridization buffer can be used for a nucleic acid sequencing reaction, or for nucleic acid amplification including rolling circle amplification and/or multiple displacement amplification reactions.

The high efficiency hybridization buffer includes an amount of a crowding agent that will permit, enhances, or facilitates molecular crowding. The amount of the crowding agent is about 1%, 2%, 3%, 5%, 10%, 15%, 20%, 25%, 30%, 35%, 40%, 50%, 60%, or higher amounts, by volume based on the total volume of the high efficiency hybridization buffer formulation. In some embodiments, the amount of a molecular crowding agent is greater than 5% by volume based on the total volume of the high efficiency hybridization buffer formulation. The amount of the crowding agent is lower than about 3%, 5%, 10%, 12.5%, 15%, 20%, 25%, 30%, 35%, 40%, 50%, 60%, 70%, 80%, 90%, or more than 90%, by volume based on the total volume of the high efficiency hybridization buffer formulation. In some embodiments, the amount of the molecular crowding agent can be less than 30% by volume based on the total volume of the formulation. In some embodiments, the amount of the polar or polar aprotic solvent is in the range of about 25% to 75% by volume based on the total volume of the formulation. In some embodiments, the amount of the polar or polar aprotic solvent is in the range of about 1% to 40%, 1% to 35%, 2% to 50%, 2% to 40%, 2% to 35%, 2% to 30%, 2% to 25%, 2% to 20%, 2% to 10%, 5% to 50%, 5% to 40%, 5% to 35%, 5% to 30%, 5% to 25%, 5% to 20%, by volume based on the total volume of the formulation. In some cases, the amount of the molecular crowding agent can be in the range of about 5% to about 20% by volume based on the total volume of the formulation. In some embodiments, the amount of the crowding agent is in the range of about 1% to 30% by volume based on the total volume of the formulation.

In some embodiments, the high efficiency hybridization buffer formulations may include the addition of a molecular crowding or volume exclusion agent. Molecular crowding or volume exclusion agents are typically macromolecules (e.g., proteins) which, when added to a solution in high concentrations, may alter the properties of other molecules in solution by reducing the volume of solvent available to the other molecules. In some embodiments, the percentage by volume of molecular crowding or volume exclusion agent included in the high efficiency hybridization buffer formulation may range from about 1% to about 50%. In some embodiments, the percentage by volume of molecular crowding or volume exclusion agent may be at least 1%, at least 5%, at least 10%, at least 15%, at least 20%, at least 25%, at least 30%, at least 35%, at least 40%, at least 45%, or at least 50%. In some embodiments, the percentage by volume of molecular crowding or volume exclusion agent may be at most 50%, at most 45%, at most 40%, at most 35%, at most 30%, at most 25%, at most 20%, at most 15%, at most 10%, at most 5%, or at most 1%. Any of the lower and upper values described in this paragraph may be combined to form a range included within the present disclosure, for example, the percentage by volume of molecular crowding or volume exclusion agent may range from about 5% to about 35%. Those of skill in the art will recognize that the percentage by volume of molecular crowding or volume exclusion agent may have any value within this range, e.g., about 12.5%.

In some embodiments, the high efficiency hybridization buffer includes a pH buffer system that maintains the pH of the compositions in a range suitable for hybridization process. The pH buffer system can include one or more buffering agents selected from the group consisting of Tris, HEPES, TAPS, Tricine, Bicine, Bis-Tris, NaOH, KOH, TES, EPPS, MES, and MOPS. The pH buffer system can further include a solvent. A preferred pH buffer system includes MOPS, MES, TAPS, phosphate buffer combined with methanol, acetonitrile, ethanol, isopropanol, butanol, t-butyl alcohol, DMF, DMSO, or any combination therein.

In some embodiments, the high efficiency hybridization buffer includes an amount of the pH buffer system that is effective to maintain the pH of the formulation to be in a range suitable for the hybridization. In some embodiments, the pH may be at least 3, at least 4, at least 5, at least 6, at least 7, at least 8, at least 9, or at least 10. In some embodiments, the pH may be at most 10, at most 9, at most 8, at most 7, at most 6, at most 5, at most 4, or at most 3. Any of the lower and upper values described in this paragraph may be combined to form a range included within the present disclosure, for example a range the pH of the hybridization buffer may range from about 4 to about 8. Those of skill in the art will recognize that the pH of the hybridization buffer may have any value within this range, e.g., about pH 7.8. In some cases, the pH range is about 3 to about 10. In some embodiments, the disclosed hybridization buffer formulations may include adjustment of pH over the range of about pH 3 to pH 10, with a preferred buffer range of 5-9.

In some embodiments, the high efficiency hybridization buffer includes an additive (e.g., polar aprotic solvent) for controlling melting temperature of nucleic acid can vary depending on other agents used in the compositions. The amount of the additive for controlling melting temperature of the nucleic acid is about or more than about 1%, 2%, 3%, 5%, 10%, 15%, 20%, 25%, 30%, 35%, 40%, 50%, 60%, or higher, by volume based on the total volume of the formulation. In some cases, the amount of the additive for controlling melting temperature of the nucleic acid is greater than about 2% by volume based on the total volume of the formulation. In some cases, the amount of the additive for controlling melting temperature of the nucleic acid is greater than 5% by volume based on the total volume of the formulation. In some cases, the amount of the additive for controlling melting temperature of the nucleic acid is lower than about 3%, 5%, 10%, 12.5%, 15%, 20%, 25%, 30%, 35%, 40%, 50%, 60%, 70%, 80%, 90%, or higher, by volume based on the total volume of the formulation. In some embodiments, the amount of the additive for controlling melting temperature of the nucleic acid is in the range of about 1% to 40%, 1% to 35%, 2% to 50%, 2% to 40%, 2% to 35%, 2% to 30%, 2% to 25%, 2% to 20%, 2% to 10%, 5% to 50%, 5% to 40%, 5% to 35%, 5% to 30%, 5% to 25%, 5% to 20%, by volume based on the total volume of the formulation. In some embodiments, the amount of the additive for controlling melting temperature of the nucleic acid is in the range of about 2% to 20% by volume based on the total volume of the formulation. In some cases, the amount of the additive for controlling melting temperature of the nucleic acid is in the range of about 5% to 10% by volume based on the total volume of the formulation.

In some embodiments, the high efficiency hybridization buffer formulations may include the addition of an additive that alters nucleic acid duplex melting temperature. Examples of a suitable additive that may be used to alter nucleic acid melting temperature include, but are not limited to, formamide. In some embodiments, the percentage by volume of a melting temperature additive included in the high efficiency hybridization buffer formulation may range from about 1% to about 50%. In some embodiments, the percentage by volume of a melting temperature additive may be at least 1%, at least 5%, at least 10%, at least 15%, at least 20%, at least 25%, at least 30%, at least 35%, at least 40%, at least 45%, or at least 50%. In some embodiments, the percentage by volume of a melting temperature additive may be at most 50%, at most 45%, at most 40%, at most 35%, at most 30%, at most 25%, at most 20%, at most 15%, at most 10%, at most 5%, or at most 1%. Any of the lower and upper values described in this paragraph may be combined to form a range included within the present disclosure, for example, the percentage by volume of a melting temperature additive may range from about 10% to about 25%. Those of skill in the art will recognize that the percentage by volume of a melting temperature additive may have any value within this range, e.g., about 22.5%.

In some embodiments, the hybridization buffer described herein includes an additive that impacts DNA hydration. In some embodiments, the disclosed hybridization buffer formulations may include the addition of an additive that impacts nucleic acid hydration. Examples include, but are not limited to, betaine, urea, glycine betaine, or any combination thereof. In some embodiments, the percentage by volume of a hydration additive included in the hybridization buffer formulation may range from about 1% to about 50%. In some embodiments, the percentage by volume of a hydration additive may be at least 1%, at least 5%, at least 10%, at least 15%, at least 20%, at least 25%, at least 30%, at least 35%, at least 40%, at least 45%, or at least 50%. In some embodiments, the percentage by volume of a hydration additive may be at most 50%, at most 45%, at most 40%, at most 35%, at most 30%, at most 25%, at most 20%, at most 15%, at most 10%, at most 5%, or at most 1%. Any of the lower and upper values described in this paragraph may be combined to form a range included within the present disclosure, for example, the percentage by volume of a hydration additive may range from about 1% to about 30%. Those of skill in the art will recognize that the percentage by volume of a melting temperature additive may have any value within this range, e.g., about 6.5%.

Compositions and methods for preparing and using the high efficiency hybridization buffers, are described in U.S. Ser. No. 16/543,351, filed on Aug. 16, 2019, the contents of which is hereby expressly incorporated by reference in its entirety.

Air Bubble Fluidics

The present disclosure provides systems and methods for handling fluidics that can be employed to conduct any of the pairwise sequencing methods described herein, including any of the in-solution or on-support rolling circle amplification reactions and/or any of the sequencing reactions. Pairwise sequencing workflows that are conducted on a flow cell in a massively parallel manner require numerous reagent changes to conduct different biochemical reactions throughout the workflow. A fluidic dispensing system can be used to deliver the reagents to the flow cell. The fluidic dispensing system needs to handle very small fluid volumes and reduce mixing of different reagents that are sequentially flowed onto the flowcell. In some embodiments, air bubbles can be introduced into the fluidics system to separate different reagents flowing onto the flow cell and reduce mixing.

The system comprises a flow cell fluidically connected to a reagent reservoir and a syringe pump. The flow cell includes an inlet on the upstream side and an outlet on the downstream side. The reagent reservoir is connected to the inlet of the flow cell and the syringe pump is connected to the outlet of the flow cell, in a manner that forms a fluid flow path from the reagent reservoir, through the flow cell, and towards the syringe pump. The system further includes an air bubble injector fluidically connected to the fluid flow path and configured to inject air bubbles between different reagents flowing through the fluid path. Fluidic lines can be used to fluidically connect the reagent reservoir, bubble injector, flow cell and syringe pump.

The system can be used to flow very small volumes of different reagents in the fluid flow path and reduce mixing of the different reagents. For example, a first fluid from the reagent reservoir enters the flow path via a fluidic line that connects the reagent reservoir and the inlet of the flow cell. An air bubble is injected into the flow path behind the first reagent in the fluidic line. A second fluid from the reagent reservoir enters the flow path via the fluidic line that connects the reagent reservoir and the inlet of the flow cell and the second reagent is behind the air bubble. The air bubble prevents mixing of the first and second reagents in the fluidic line before the reagents reach the flow cell. Subsequent air bubbles and reagents can be flowed through the flow cell. The system further comprises an air bubble aspirator that removes the air bubble between the first and second reagents so that the first and second reagents are flowed sequentially onto the flow cell with no air bubble. The air bubble aspirator is configured to enable introduction of air bubbles between different reagents in the fluidic line before entry onto the flow cell so that air bubbles do not flow onto the flow cell. The syringe pump is configured to pull the first and second fluids and the air bubble along the flow path from the reagent reservoir and towards the outlet of the flow cell. In this manner, different reagents can be flowed sequentially onto the flow cell with no air bubbles.

The system includes at least one reagent reservoir each reservoir having a plurality of separate compartments, and each compartment holding a reagent for conducting a biochemical or biological reaction. The reservoir(s) contain reagents for conducting nucleic acid amplification and/or nucleic acid sequencing reactions on the flowcell. Each compartment can hold a different reagent in fluid form for conducting a nucleic acid amplification reaction, a nucleic acid sequencing reaction, or washing reagent. For example, a first reservoir compartment can hold a plurality of amplification polymerase, a plurality of amplification primers, a mixture of four different nucleotide triphosphates or analogs thereof (e.g., dATP, dGTP, dCTP or dTTP) and a nucleotide comprising a scissile moiety. A second reservoir compartment can hold a plurality of sequencing polymerases, a plurality of soluble sequencing primers, and a mixture of nucleotide triphosphates or analogs thereof (e.g., dATP, dGTP, dCTP or dTTP). A third reservoir compartment can hold a plurality of sequencing polymerases, a plurality of soluble sequencing primers, and a mixture of multivalent molecules where individual multivalent molecules comprises nucleotide arms having nucleotide units of dATP, dGTP, dCTP or dTTP. A fourth reservoir compartment can hold a plurality of linear or circular library molecules. A fifth reservoir compartment can hold a wash buffer.

The system includes at least one flow cell having at least one channel. In some embodiments, the flow cell contains 1, 2, 3, 4, or more channels. In some embodiments, the system includes two or more flow cells. Each flow cell can be configured with a plurality of channels arranged in parallel to each other. Each channel has an inlet on the upstream side and an outlet on the downstream side. The flow cell(s) is/are mounted in the fluidics system so that the inlet side of each channel is/are fluidically connected to the reagent reservoir, and the outlet side of each channel is/are fluidically connected to the syringe pump.

The flow cell channels have a surface that can be coated with at least one hydrophilic polymer layer, or at least one functionalized polymer coating. The channel surface can include at least one surface capture primer immobilized on or embedded in the coating. The channel surface can include at least 1000 immobilized surface capture primers per $mm^2$. The immobilized surface capture primers on the surface of the channel can be in fluid communication with each other during fluid flow through the channel to permit essentially simultaneously reaction with the reagents in a massively parallel manner. The immobilized surface capture primers can hybridize to linear or circular nucleic acid library molecules each having a sequence of interest. The hybridized linear or circular nucleic molecules can be subjected to an amplification reaction (e.g., a rolling circle amplification reaction) in the channel using the fluidic system to generate a plurality of concatemers. The plurality of concatemers in the channel can be subjected to successive sequencing reactions using the fluidic system.

EXAMPLES

The following examples are meant to be illustrative and can be used to further understand embodiments of the present disclosure and should not be construed as limiting the scope of the present teachings in any way.

Example 1: On-Support Rolling Circle Amplification

On-Support Rolling Circle Amplification:
A support having a low non-specific binding coating with a plurality of one type of surface primers (e.g., first surface primers) immobilized thereon was prepared. The first surface primers included an extendible 3'OH end and lacked any nucleotide having a scissile moiety (e.g., lacked uracil, 8oxoG and deoxyinosine). Optionally, the coating also included a plurality of a second type of surface primers (e.g., second surface primers) which lacked any nucleotide having a scissile moiety and included a non-extendible 3' phosphate group.

The circular library molecules included a sequence of interest (e.g., insert size ranged from 150-400 bases) and a primer binding sequence for each of the following: first surface primer; forward sequencing primer; and reverse sequencing primer. The circular library molecules optionally included a primer binding sequence for a second surface primer.

A preparation of a single stranded circular nucleic acid library was distributed onto the support and incubated under a condition suitable for hybridizing the circular library molecules to the first surface primers to form library-primer duplexes. For example, the hybridization was conducted at 70° C. for about 3 minutes, and at 55° C. for 3 minutes, and at 37° C. for 3 minutes, and at room temperature for 3 minutes. The support was washed 3 times with a buffer containing Tris (pH 8), NaCl, EDTA and Tween-20.

A two-stage rolling circle amplification reaction was conducted. In the first stage, the library-primer duplexes were contacted with a strand displacing polymerase (e.g., phi29, amplifying polymerase) in the presence of a binding buffer that lacked magnesium and nucleotides under a condition suitable for the polymerase to bind the library-primer duplexes to form complexed polymerases but inhibit polymerase-catalyzed nucleotide incorporation. For example, the polymerase was incubated with the library-primer duplexes at room temperature for about 15 minutes. The binding buffer was removed. In the second stage, the rolling circle amplification reaction (primer extension) was initiated by adding an extension buffer that included $MgCl_2$ a mixture of nucleotides (e.g., about 1 mM each of dATP, dGTP, dCTP and dTTP) and dUTP (e.g., 1 µM or 10 µM dUTP). The rolling circle amplification reaction contained varying amounts of dUTP (e.g., about 1%, about 2.5%, about 5%, about 10% or about 15%). Optionally, a plurality of condenser oligonucleotides were added (e.g., 25–200 nM). The rolling circle reaction was incubated at 45° C. (isothermal condition) for about 60 minutes (or less than 60 minutes) to generate a plurality of immobilized concatemers. The reaction was cooled to room temperature and washed several times.

Read 1 Sequencing:
A two-stage sequencing reaction was conducted. The first-stage sequencing reaction was conducted by hybridizing a plurality of a soluble forward sequencing primers (e.g., 5' exonuclease-resistant primers) to the immobilized concatemers to form primer-concatemer duplexes. A plurality of a first sequencing polymerase was added to the duplexes and incubated under a condition suitable to bind the sequencing polymerase to the duplexes to form complexed polymerases. A mixture of fluorescently labeled multivalent molecules (e.g., about 40-100 nM) was added to the complexed polymerases in the presence of a buffer that included a non-catalytic cation (e.g., strontium or barium) and incubated under conditions suitable to bind complementary nucleotide units of the multivalent molecules to the complexed polymerases without polymerase-catalyzed incorporation of the nucleotide units. The complexed polymerases were washed. An image was obtained of the fluorescently labeled multivalent molecules that remined bound to the complexed polymerases. The first sequencing polymerases and multivalent molecules were removed, while retaining the sequencing primers hybridized to the concatemers (retained duplexes), by washing with a buffer comprising a detergent.

The second-stage sequencing reaction was conducted by contacting the retained duplexes with a plurality of second sequencing polymerases to form complexed polymerases. A mixture of fluorescently labeled nucleotide analogs (e.g., 3'O-methylazido nucleotides) (e.g., about 1-5 µM) was added to the complexed polymerases in the presence of a buffer that included a catalytic cation (e.g., magnesium) and incubated under conditions suitable to bind complementary nucleotides to the complexed polymerases and promote polymerase-catalyzed incorporation of the nucleotides to generate a nascent extended sequencing primer. The complexed polymerases were washed. An image was obtained of the incorporated fluorescently labeled nucleotide analogs as a part of the complexed polymerases. The incorporated fluorescently labeled nucleotide analogs were reacted with a cleaving reagent that removes the 3' O-methylazido group and generates an extendible 3'OH group. The second sequencing polymerases were removed, while retaining the nascent extended sequencing primers hybridized to the concatemers (retained duplexes), by washing with a buffer comprising a detergent. Recurring sequencing reactions were conducted by performing multiple cycles of first-stage and second-stage sequencing reactions to generate extended forward sequencing primer strands. FIG. 118 (left) shows a comparison of error rates determined for the concatemers generated with varying amounts of dUTP (e.g., about 1%, about 2.5%, about 5%, about 10% or about 15%). FIG. 118 (right) shows a comparison of phasing rates determined for the concatemers generated with varying amounts of dUTP (e.g., about 1%, about 2.5%, about 5%, about 10% or about 15%).

Replacing the Extended Forward Sequencing Primer Strands:
The extended forward sequencing primer strands were contacted with a plurality of strand displacing polymerases (e.g., Phi29 polymerase) and a mixture of nucleotides in the absence of newly added soluble primers (e.g., no soluble sequencing primers and no soluble amplification primers). The mixture of nucleotides included dATP, dGTP, dCTP and dTTP. Optionally, compaction oligonucleotides were added (e.g., about 100 µM). The reaction was incubated at 45° C. for about 30 minutes to generate a plurality of forward extension strands that are hybridized to the immobilized concatemer molecules. The support was washed several times with a wash buffer comprising Tris-HCl, NaCl, EDTA and Tween-20.

Generating Abasic Sites and Gaps:

The plurality of forward extension strands were contacted with Thermolabile USER™ (II) enzyme (0.02 U/uL) (e.g., from New England Biolabs, catalog #M5508S), and T7 exonuclease (02 U/uL) (e.g., from New England Biolabs, catalog #M0263S), and 1× CutSmart buffer (e.g., from New England Biolabs, catalog #B7204S), and incubated at 37° C. for about 15 minutes, and then at 25° C. for about 15 minutes to generate a plurality of abasic sites in the immobilized concatemer molecules and to generate gaps at the abasic sites. The forward extension strands were retained as intact molecules. The support was washed several times with a wash buffer comprising Tris-HCl, NaCl, EDTA and Tween-20 to remove the gap-containing concatemer molecules.

Read 2 Sequencing:

A two-stage sequencing reaction was conducted as described in 'Read 1 sequencing' described above, except that the first-stage sequencing reaction was conducted by hybridizing a plurality of a soluble reverse sequencing primers (e.g., 5' exonuclease-resistant primers) to the retained forward extension strands to form primer-extension strand duplexes.

Example 2: In-Solution Initiated Rolling Circle Amplification

In-Solution Initiated Rolling Circle Amplification:

A support having a low non-specific binding coating with a plurality of one type of surface primers (e.g., first surface primers) immobilized thereon was prepared. The first surface primers included an extendible 3'OH end and lacked any nucleotide having a scissile moiety (e.g., lacked uracil, 8oxoG and deoxyinosine). Optionally, the coating also included a plurality of a second type of surface primers (e.g., second surface primers) which lacked any nucleotide having a scissile moiety and included a non-extendible 3' phosphate group.

The circular library molecules included a sequence of interest (e.g., insert size ranged from 150-400 bases) and a primer binding sequence for each of the following: a soluble amplification primer; first surface primer; forward sequencing primer; and reverse sequencing primer. The circular library molecules optionally included a primer binding sequence for a second surface primer.

The circular library molecules (at 1-8 nM) were hybridized with soluble amplification primers (at 2-80 nM)(e.g., about 2-10 equivalents) in a buffer containing 10 mM ACES pH 7.4, 10 µM dNTPs (total), 1 mM strontium acetate, 0.01% Tween-20, (and optionally 50 mM ammonium sulfate). The hybridization mixture was heated to 85° C. and cooled to 40° C. with 5° C. steps, 30 second dwell time at each step, and 0.2° C./second ramp rate between steps, for a total of 10 minutes. The mixture was incubated at a temperature that was about 1-10° C. below the Tm of the primer, for about 10 minutes.

To the hybridization mixture described above, a trapped nucleotide-polymerase mixture was prepared by adding DTT to a final concentration of 1-50 mM, Phi29 polymerase at 2-10 equivalents with respect to the soluble amplification primer, and a 5× trap buffer so that the final concentration of the ACES, dNTPs, strontium acetate and Tween-20 was the same as in the hybridization mixture. The trapped nucleotide-polymerase mixture was incubated at room temperature, or different temperatures up to 35° C., for 15 minutes.

A nucleotide polymerization reaction mixture was prepared by diluting the trapped nucleotide-polymerase mixture (about 40-1000× dilution) with extension buffer so the final concentration included 50 mM ACES pH 74, 100 mM potassium acetate, 10 mM magnesium sulfate, 2 mM dNTPs, 10 mM DTT, 0.01% Tween-20, 50 mM ammonium sulfate, and concentration of the circular library molecules was 5-100 µM.

The nucleotide polymerization reaction mixture was distributed onto a support immobilized with two different types of surface capture primers, and incubated at 30-45° C. for 5 minutes (but time ranges up to 2 hours were also tested) for a rolling circle amplification reaction. Alternatively, the nucleotide polymerization reaction mixture was incubated at 30-45° C. for 30 minutes and then distributed onto the support, and the rolling circle amplification reaction continued on the surface for 5 minutes or up to 2 hours.

The support was washed with a wash buffer containing 50 mM Tris-HCl pH 8, 750 mM NaCl, 0.1 mM EDTA, and 0.02% Tween-20. The reaction was cooled to room temperature and washed several times.

Read 1 Sequencing:

A two-stage sequencing reaction was conducted as described above in Example 1.

Replacing the Extended Forward Sequencing Primer Strands

The extended forward sequencing primer strands were replaced with forward extension strands as described above in Example 1.

Generating Abasic Sites and Gaps

Abasic sites and gaps were generated in the forward extension strands as described above in Example 1.

Read 2 Sequencing:

A two-stage sequencing reaction was conducted as described above in Example 1.

Example 3: Clarified Lysate Preparation of Mutant Polymerases

Mutant polymerases were prepared using site directed mutagenesis. The mutated sites of the mutant polymerases are listed in Tables 1-14 (FIG. 138-151).

Host cells harboring an expression vector operably linked to a nucleic acid encoding a wild type polymerase or one of the mutant polymerases were prepared. The host cells were cultured under conditions suitable for expressing the wild type or mutant polymerase. The host cells were grown in plate format and centrifuged after expression. Cell pellets were lysed by treatment with lysozyme in buffer (20 mM Tris-HCl (pH 8.8), 10 mM KCl, 10 mM $(NH_4)_2SO_4$)) and centrifuged again. The supernatants were transferred to PCR plates and heat shocked at 65° C. for 60 minutes. The heat shocked lysates were then clarified by centrifuge and the supernatants transferred to a new plate for the nucleotide incorporation assay.

Example 4: Nucleotide Incorporation Assay

Atto dye-labeled DNA templates were used to prepare the DNA duplexes. The labeled DNA templates were annealed with primers in a reaction buffer (Tris-HCl (pH 7.5), NaCl, EDTA). The duplexes were mixed with the clarified lysates (described in Example 1) and allowed to equilibrate to 42° C. The nucleotide incorporation reaction was started with the addition of a 3' methylazido nucleotide corresponding to the next base on the template (e.g., dCTP-N3). The reaction was allowed to proceed under different temperature and time conditions, for example 42° C. for 150 seconds, or 56° C. for as little as 2 seconds, and quenched with EDTA and formamide. The analysis of the n+1 vs n was performed by capillary electrophoresis.

The incorporation data listed in Table 1 (FIG. 138), Table 4 (FIG. 141), Table 7 (FIG. 144), Table 9 (FIG. 146), Table 11 (FIG. 148) and Table 12 (FIG. 149) represent the relative activity of mutant polymerases compared to wild type enzyme in incorporation of 3'methylazido nucleotides at the N+1 position of an extending polynucleotide chain at 42° C.

Numerous mutant polymerases were expressed by recombinant host cells as described in Example 3. Lysates from the expression host cells, which contained mutant polymerases, were subjected to heat shock at 65° C. for 60 minutes. The mutant polymerases in the heat shocked lysates were screened for their ability to incorporate a 3' methylazido nucleotide as described here in Example 4. Analysis of the incorporation reactions were conducted via capillary electrophoresis as described here in Example 4. The incorporation activities of the mutant polymerases were assigned a grade of 0 if they exhibited zero or negligible incorporation activity, or assigned a grade of + or ++ if they exhibited moderate or high incorporation activity respectively. It was predicted that approximately 50-60% or more of the mutant polymerases would exhibit incorporation activity having a grade of + or higher.

Example 5: Thermal Melt Assays

Purified wild type and mutant polymerases in a heparin elution buffer was mixed with 1×SYPRO Orange Protein Gel Stain and run on a CFX384 thermocycler. The thermal melt data was analyzed using a CFX Maestro software (from Bio-Rad). Thermal melt data (™) for wild type and mutant polymerases having backbone sequences RLF 89458.1, NOZ 58130 or WP 175059460.1 were conducted.

Example 6: Uracil Incorporation Assays

Primed DNA template molecules in a reaction buffer was mixed with a purified mutant polymerase and allowed to equilibrate to 42° C. The reaction was started by adding a 3' methylazido nucleotide corresponding to the next base on the template molecule. The reaction was allowed to proceed at 42° C. and quenched with EDTA and formamide at incremental time points. Analysis of the n+1 versus n was performed by capillary electrophoresis. The incorporation rates of dATP nucleotide analog into a template having a thymine as the next base in the template molecule was assayed. The incorporation rates of dATP nucleotide analog into a template having an adenine as the next base in the template molecule was assayed. The incorporation rates of dATP nucleotide analog into a template having a uracil as the next base in the template molecule was assayed. Some of the mutant polymerases exhibited increased capability for incorporating a dATP nucleotide analog into a uracil-containing template molecule.

Example 7: Assay for Binding Labeled Multivalent Molecules

DNA concatemers were prepared and immobilized to flowcells. A solution of fluorescently-labeled multivalent molecules (e.g., see FIG. 107) and engineered polymerase enzyme was flowed onto the flowcells. Each solution contained multivalent molecules carrying nucleotide units of dATP, dGTP, dCTP or dTTP. The core of the multivalent molecules were labeled with different fluorophores that correspond to the nucleotide units of dATP, dGTP, dCTP or dTTP. The concatemers were reacted with the solution for 10 seconds, then removed using air. The multivalent molecules and polymerase enzyme was removed with a wash buffer. An imaging solution was flowed onto the flowcell and the fluorescent intensity of the multivalent molecules bound to the concatemers was measured. The purity of the bound nucleotide unit was calculated by dividing the fluorescent intensity of the dominant nucleotide unit (e.g., the correct nucleotide unit) by the sum of the intensities of all four nucleotide units. The multivalent binding data is listed in Table 2 (FIGS. 139-1 through 139-26) and Table 5 (FIG. 142). The intensity exhibited by the mutant polymerases were assigned a grade of 0 if they exhibited zero or negligible activity, or assigned a grade of + or ++ if they exhibited moderate or high activity respectively. It was predicted that approximately 50-60% or more of the mutant polymerases would exhibit intensity having a grade of + or higher.

In a separate assay, complexed engineered polymerases were reacted with fluorescently labeled multivalent molecules carrying nucleotide units of dATP, dGTP, dCTP or dUTP, under different temperature and time conditions. For example, the temperature tested included 25-56° C., and the time during included 1-90 seconds. Images and intensities of multivalent molecules binding the complexed polymerases were acquired.

SEQUENCE LISTING (2524 sequences)

SEQ ID NO: 1 - protein, 773 aa, unidentified
  REGION 1..773: note = Description of Unknown: Thermococci archaeon sequence
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFDIETFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 2 - protein, 773 aa, unidentified
  REGION 1..773: note = Description of Unknown: Thermococci archaeon sequence
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFDIETFYHEGDEFAEGEILMISYADESGAKVITWKKIDLPYVEVVSTEREAIKRFLQVLREKDPDVLLTYNGDNFDFAYIKKRCEKLGLKFTIGREGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 3 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIVTHNVSPDTLEKECKNYDVAPIVGYRFCKDFKGFIPSILEDLIETRQKVKRKMKATIDPIEKKMLDYRQRSLKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 4 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 5 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 6 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESVEDIRKITGERHGKKVRIIRVEKVKKKFLDEPIEVWKLAFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 7 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATSPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 8 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRVVRVEKVKKKFLGEPIEVWKLVFEHPQDVPAKRDAIRSHPAVREIFGYDIPFAKRYLIDKGLVPMVGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 9 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYAISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 10 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDKKKITGERHGMKVRIIRVEKVKKKFLGESIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 11 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIRFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 12 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITDERHGKKVRIIRVEIVKKKFLGEPIEVWKLVFEHPQDVPAIRDAIRSHPAVREIFEYDIPFAKCYLIDKGLVPMEGGEEPKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 13 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 14 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKNFLKHINEKLPSILELEYEGFYLRDFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 15 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLTNYRVPVEKLIIHEQITRELKDYKATGPHVAIAKRLQARGIKVKPGTIISYVVLKGSKKISDRVILFDEYYSSRHKYDPDYYIHNQVLPAVLRILEAFGYKEKDLEYQRMKQTGLGAWLKMGKK

SEQ ID NO: 16 - protein, 773 aa, synthetic construct
  REGION 1..773: note = Description of Artificial Sequence: Synthetic polypeptide
MILDTDYITENGKPVIRIFKKEKGEFKIVYDRNFEPYIYALLEDDESIEDIKKITGERHGKKVRIICVEKVKKKFLGEPIEVWKLVFEHPQDVSAIRDAIRSHPAVREIFEYGIPFAKRYLIDKGLVPMEGGEELKLLAFAFATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 17 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVFLFDEYDSSRHKYDPDYYIHNQVLPAVLRILEAFGYKEKDLEFQRMKQTGLGAWLKMGKK

SEQ ID NO: 18 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANHRMPVEKLIIHEQITRELKGYKATGPHVAIAKRLQARGIKVKPGTIISYVVLKGSKKISDRVILFNEYDSSRHKYDPDYYIHNQVLPAVLRILEAFGYKEKELEYQRMKQTGLGAWLKMGKK

SEQ ID NO: 19 - protein, 773 aa, synthetic construct
  REGION 1..773: note = Description of Artificial Sequence: Synthetic polypeptide
MILDTDYITENGKPVIRIFKKEKGEFKIEYDRNFKPYIYALLEDDESIEDIKKITGERHGKKVRIIRVEKVKEKFLGEPIEVWKLVFEHPQVVPAIRDAIHSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 20 - protein, 773 aa, synthetic construct
  REGION 1..773: note = Description of Artificial Sequence: Synthetic polypeptide
MILDTDYITENGKPVIRIFKKEKGEFKIEYDRNIEPYIYALLEDDESIEDIKKITGERHGKKVRIIRVEKVKKKFLGEPIEVWKLVFEHPRDVPAIHDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 21 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 22 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 23 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDMPAIRDAIRSHPAVREIFEYDIPFAKRYLIDKGLVPMESGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 24 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 25 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVFAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 26 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEMAAGIVKKVAEDLANYRVPVEKLIIHEQITRELKDYKATGPHVAIAKRLQARGIKVKPGTIISYVVLKGSKKISDRVILFDEYVSSRHKYDPDYYIHNQVLPAVLRILEALGYKEKVLEYQRMKQTGLGAWLKMGKK

SEQ ID NO: 27 - protein, 773 aa, synthetic construct
  REGION 1..773: note = Description of Artificial Sequence: Synthetic polypeptide
MILDTDAITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 28 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSLECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 29 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRNIRVEKVKKKFLGEPIEVWKLVCEHPQDVSAIRDTIRSHPAVREIFEYDIPFAKRYLIDKGLVPLEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 30 - protein, 773 aa, synthetic construct
  REGION 1..773: note = Description of Artificial Sequence: Synthetic polypeptide
MILDTDYITENGKPVIRIFKKGKGEFKIEYDRNFEPYIYALLEDDESIEDIKKTTGERHGKKARIIRVEKVKKKFLGEPIEVWKLVFEHPQNVPAIRDAIRSHPAVREIFEYDIPFAKRYLIDNGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 31 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGECHGKKVRIIRMEKVKKKFLGEPIEVWKLVFEHLQDVPAIRDTIRSHPAVREIFEYDIPFAKRYLIDKGLVPMEGGEELRLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 32 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 33 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYAVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 34 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPSIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 35 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGGPIEVWKLVFEHPQDVPAIRDAIRSHPAVRENFVYDIPFAKRYLINKGLVPMVGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 36 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRNSTGNLVEWYLLRVAYERNELAPNKPSGEEYQRRMRSSYIGGYVKEPEKGLWESIAYQDFRSSAGSIIVTHNVSPDTQEKECKNYDVAPIVGYRFCKDFKGIIPSILEDLIETRQKMKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 37 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 38 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSGISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 39 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEDPQDVPATRDAIRSHPAVREIFEYDIPFAKRYLIDKGLVPMEGGEELKFLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 40 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIIKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 41 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYNETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 42 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRAFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 43 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPKVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 44 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 45 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYRRRMRSSYIGGYVKEPEKGLWESIAYLDYRSSAGSIIVTHNVSPDILEKECKNYDVAPIVGYRFCKDFKGFIPSILEDLIETRQKVKRKMKATIDPIEKKMLDYRQRTLKILANSYYGYHGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 46 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIRTHNVSPDTLEKECKNYDVDPIVGYRFCKDFKGFIPSILEDLIETRQKVKRKMKATIDPIEKKMLDYRQRSLKILANSYYGYQGYPKARWYSLECAESVTAWGRHYHETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 47 - protein, 773 aa, synthetic construct
  REGION 1..773: note = Description of Artificial Sequence: Synthetic polypeptide
MILDTDYITENEKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 48 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPRVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 49 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGNPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVDPIVGYRFCKDFKGFIPSILEDLIETRQKVKRKMKATIDPIEKKMLDYRQRSLKILANGYYGYQGYPKARWYSLECAESVTAWGRHYTETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 50 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIRTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 51 - protein, 773 aa, synthetic construct
  REGION 1..773: note = Description of Artificial Sequence: Synthetic polypeptide
MILDTDYITDNSKPVIRIFKKVKSEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIEKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 52 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSLECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 53 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKFSDRVILFDEYDSSRHEYDPDYYIHNQVLPAVLRILEAFGYKEKDLEYQRMKQTGLGAWLKMGKK

SEQ ID NO: 54 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 55 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKESAESVTAWGRHYIETTIKEAEKFGFKVLYADTDGFFATIPNEKPETIKCKAKKFLKHINEKLPGMLELEYEGFYLRGFFVTKKKYALTDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 56 - protein, 773 aa, synthetic construct
  REGION 1..773: note = Description of Artificial Sequence: Synthetic polypeptide
MILDTSYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 57 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRAAYERNELAPNKPGGEEYQRRMRSSYIGGYVKEPGKGLWESIAYLDFRSSAGSIIVTHNVSSDTLEKECKNYDVAPIVGYRFCRDFKGFIPSILEDLIETRQKVKRKMKATIDPIEKKMLDYRQRALKILANSYYGYHGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 58 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYPLHVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 59 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 60 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVMPGTIISYVVLKGSKMISDRVILFDEYDSSRHKYDPDYYIHNQVLPAVLRILEAFGYKEKDLEYQRMKQTGLGAWLKMGKK

SEQ ID NO: 61 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 62 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNEPAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 63 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSGGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 64 - protein, 773 aa, synthetic construct
  REGION 1..773: note = Description of Artificial Sequence: Synthetic polypeptide
MILDTDYITENSKPVIRIFKKEKGEFKIEYDCNFEPYIYALQENDESIEDIKKITGGRHGKKVRINRVEKVKKKFLGEPIEVWKLVFEHPQDVPAICVAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 65 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDFKEIIGKRHGKKVRIIRVEKVKKKFQGEPIEVWKLVFEHPQDVPVICDAIRSHPAVREIFEYDIPFAKRYLIDKGFVPMEGGEELKLLEFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 66 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 67 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 68 - protein, 773 aa, synthetic construct
  REGION 1..773: note = Description of Artificial Sequence: Synthetic polypeptide
MILDTDYITENGKPMIRIFKKEKGEFKTEYDRNFEPYIYALLKDDESIEDIKKITGERHGKRVRIIRVEKVKKKFLGEPIEVWKLVFEHPQDVPAICDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 69 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 70 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 71 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 72 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIDVWKLVFEHRQDVPAIRDAIRSHPAVREIFEYDIPFAKRYLIVEGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 73 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLQEWYLLRVAYERNELAPNKPGGEEYQRRMRSSYIGGYVKEPEKGLWESIAHLDFRSSAGSFIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 74 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVDPIVGYRFCKDFKGFIPSILEDLIETRQKVKRKMKATIDPIEKKMLDYRQRSLKILANGYYGYQGYPKARWYSLECAESVTAWGRHYIEITIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 75 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFGVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 76 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKEVAESVTAWGRHYTETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 77 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYSYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 78 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWCLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 79 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 80 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 81 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRNAIRSHPAVSEIFEYDIPFAKHYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 82 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 83 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 84 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYCKECAESVTAWGCHYIETTIKEAEKFGFKVLYADTDGFFATIPNEKLETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 85 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 86 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 87 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIVTHNVSPDTLEKECKNYDVAPIVGYRFCKDFKGFIPSILEDLIETRQKVKRKMKATIDPIEKKMLDYRQRSLKILANGYYGYQGYPKARWYSLECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 88 - protein, 773 aa, synthetic construct
  REGION 1..773: note = Description of Artificial Sequence: Synthetic polypeptide
MILDTDYITENGKPVIRIFKKEKGEFMIEYDRNFEPYIYALLEDDESIEDIKKITGERHGKKVRIIRVEKVKKKFLGEPIEVWKLVFEHPQNVPAIRDAIRSHPAVREIFEYDIPFAKRYLIDKGLVPMEGGEELKLLASAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 89 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 90 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQTKVLELILREGSIEKAAGIVKKVVEDLENYRVPVEKLIIHEQITRELKDYKTTGPHVAIAKRLQARGIKVKPGTIISYVVLKGSIKISDRVILFDEYDSSRHKYDPDYYIHNQVLPAVLRILEALGFKEKDLEYQRMKQTGLGAWLKMGKK

SEQ ID NO: 91 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILRESSIEKAAGIVKKEVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 92 - protein, 773 aa, synthetic construct
  REGION 1..773: note = Description of Artificial Sequence: Synthetic polypeptide
MILDTDYITENGKPVIRIFKEEKGEFKIVYDRNFEPYIYALLDDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 93 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKEAGIVKKVVEDLANYRVPVERLIIHEQITRELKDYKATGPHVVIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 94 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVDPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 95 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKSGGEEYQRRMRSSYIGGYVKEPEKGLWESIAYLDFRSSAGSIIMTHNVSPDTLEKECKNYDVAPIVGYRFCKDFKDFIPSILENLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 96 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGSYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 97 - protein, 773 aa, synthetic construct
  REGION 1..773: note = Description of Artificial Sequence: Synthetic polypeptide
MILDTDYITENGKPVIRIFKKEKGEFKIEYDRNFGPYIYALLEDDESIEDIKKITGERHGKKVRITRVEKVKKKFLGEPIEVWKLDFEHPQDVPAIREAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 98 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDAPAIRDAIRSHPAVREIFEYDIPFAKRYLIDKGLVPMGGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 99 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYAGYQGYPKARWYSLECAESVTAWGRHYHETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 100 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 101 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 102 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFGASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 103 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDVSIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 104 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 105 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGRYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 106 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVCRSSTGNLVEWNLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 107 - protein, 773 aa, synthetic construct
  REGION 1..773: note = Description of Artificial Sequence: Synthetic polypeptide
MILDTDYITENGKPVIRIFKKEKGEFKNEYDRNFEPYIYALLEDDESIEDIKKITGERHGKKVRIIRVEKVKKKFLGEPIEVWKLVFEHPQDVPAISDAIRSHPAVRVIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 108 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELEDYKATGPHVAIAKREQARGIKVKPGTIISYVVLKGSKKISDRVIQFDVYDSSHHKYDPDYYIHNQVLPAVLRILEAFGYKEKDLEYQRMKLTGLGAWLKMGKK

SEQ ID NO: 109 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 110 - protein, 773 aa, synthetic construct
  REGION 1..773: note = Description of Artificial Sequence: Synthetic polypeptide
MILDTDYITENGKPVIRIFKKEKGEFKIEYDRNFEPYIYALPEDDESIEDIKKITGERHGKKVRFIRVEKIVKKFLGEPIEVWKLVFEHPQDVPAICDATRSHTAVREIFEYDIPFAKRYLIDKGLVPMEGGEELELLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 111 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 112 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDQANYRVPVEKLIIHEQITRELKDYKATGPHVAIAKRLQARGIKVKPGTIKSYVVLKGSKKISDRVILFDEYDSSRHKYDPDYYIHNQVLPAVLRILEAFGYKEKDLEYQRMKQTGLGAWLKMGKK

SEQ ID NO: 113 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSLECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 114 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERLGKKDRIIRMEKVKKKFLGEPIEVWKLVFEAPQDVPAIRDAIRSHPAVREIFECDIPFAKRYLNDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 115 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGEHHGKKVRIIRVKKVKKKFLGEPIEVWKLVFEHPLDVPAIRDAIRGHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 116 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKTTGERHGKKVRIIRVEKVKKKFLGEPIEVWKLVFEHPQDVPAIRDAIRSHPAVREIFEYGIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 117 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILCEGSIEKAAGIVKKVVEDLVNHRVPVEELIIHEQITRELKDYKATGPHVAIAKRLQARGIKVKPGTIISYVVLKGSKKISDRVILFDKYDSSRHKYDPDYYIHNQVLPAVLRILEAFGYKEKDLEYQRMKQTGLGAWLKMGKK

SEQ ID NO: 118 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 119 - protein, 773 aa, synthetic construct
  REGION 1..773: note = Description of Artificial Sequence: Synthetic polypeptide
MILDTDYITENGKPVIRIFKKEMGEFKIEYVRNIEPYIYALLEDDESIEDIKKITGERHDKKVRIIRMEKVKKKFLGEPIEVWKLIFEHPQDVPAIHDAIRSHPAVCEISEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 120 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKEIQAKVLEVILREGSIEKAAGIVKKVVEDLANYRVPVEKLIIHEQVTRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 121 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 122 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYHETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 123 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDISFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 124 - protein, 773 aa, synthetic construct
  REGION 1..773: note = Description of Artificial Sequence: Synthetic polypeptide
MILDTDYITENGKPVIHIFKKEKGEFKIEYDRNFEPYIYALLEDDESIEDIKKITGERHDKKVRIIRVEKVKKKFLGEPIEVWKLVFEHPQDVPAIRDAIRSHPAVREIFEYDIPFAKRYLIEKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 125 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 126 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 127 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERSELAPNKPGGEEYQRRMRSSYIGGYVKEPEKGLWESIAYLDFRSSAGSIIVTHNISPDTLEKECKNYDVAPFVGYRFCKDFKGFIPSIQEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 128 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKSTGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 129 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLGISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 130 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRSLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 131 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERYGKKVRIIRVEKVKKKFLGEPIEVWKLVFEHPQDVPAIRDAIRSHPAVREIFGYDIPFAKRYLIDKGLVPKEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 132 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 133 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 134 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKNTGERHGKKVRIIRVEKVKKKFLGEPIEVWKLVFEHPQDVPAIRDAIRSHPAVREIFEYDIPFTKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 135 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 136 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILHEGSIEKAAGIVKKVVEDLANYRVPVEKLIIHEQITRELKDYKATGPHVAIAKRLQARGIKVKPGTIISYVVLKGCKKISDRVILFDEYDSSRHKYDPDYYIHNQVLPAVLRILEAFGYKEKDLEYLRMKQTGLGAWLKMGKK

SEQ ID NO: 137 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHRQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 138 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPFVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRIAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 139 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIKTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 140 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 141 - protein, 773 aa, synthetic construct
  REGION 1..773: note = Description of Artificial Sequence: Synthetic polypeptide
MILDTDYITENGKPVIRISKKEKGEFKIEYDRNSEPYIYALLEDDESIEDIKKIIGERHGKKVRIIRVEKVKKKFLGEPIEVWKLVFEHPQDVPAIRDAIRSHPAVREIFEYDTPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 142 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSRPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 143 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVSVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 144 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 145 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 146 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHLQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 147 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILHEGSIEKAAGIVKKVVEDLANYRVPVEKLIIHEQITRELKDYKATGPHVAIAKRLRARGIRVKPGTIISYVVLKGSKKISDRVILFDEYDNSRHKYDPDYYIHNQVLPAVLRILEAFGYKEKDLEYLRMKQTGLGAWLKMGKK

SEQ ID NO: 148 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYGASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 149 - protein, 773 aa, synthetic construct
  REGION 1..773: note = Description of Artificial Sequence: Synthetic polypeptide
MILDTDYITENDKPVIRIIKKEKGEFKIEYDRNFEPYIYALLEDDESIEDIKKITGKRHSKKVRIIRVEKVKKKFLGEPIEVWKLVFEHPQDVPAIRDAICSHPAVREIFEYDIPFAKRYLIGKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 150 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFGGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 151 - protein, 773 aa, synthetic construct
  REGION 1..773: note = Description of Artificial Sequence: Synthetic polypeptide
MILDTDYITENGKPVNRIFKKEKGEFKIEYDRNSEPYIYALLEDDESIEDIKKITGERHGKKVRIIRVEKVKKKFLGEPIEVWKLVFEHPQDVPAIRDAIRSHPAVREIFEYDIPFAMRYLIDKGLVPMEGGEELRLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 152 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSSPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 153 - protein, 773 aa, synthetic construct
  REGION 1..773: note = Description of Artificial Sequence: Synthetic polypeptide
MILDTDYITENGKPVIRIFKKEKGEFKNEYDRNFEPYIYALLEDDESIEDIKKITGECHGKKVRIIRVEKVKKKFLGEPIEVWKLVFEHLQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 154 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSCTGNLVEWYLLRVAYERNELAPNKPGGEEYQRRMRSSYIGGYVKEPEKGLWESIAYLDFRSSAGSIIVTHNVSPVTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 155 - protein, 773 aa, synthetic construct
  REGION 1..773: note = Description of Artificial Sequence: Synthetic polypeptide
MILDTDYITENGKPVIRIFKKEKGEFKIEYDRNFELYIYALLEDDESIEDIKKITGERHGKKVRIIRVEKVKKKFLGEPIEVWKLVFEHPQDVPAIRDAIRSHPAVREIFVYDIPFAKRYLIDKGLVPMEGGEELELLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 156 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVDPIVGYRFCKDFKGFIPSILEDLIETRQKVKRKMKATIDPIEKKMLDYRQRSLKILANGYYGYQGYPKARWYSLECAESVTAWGRHYHETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 157 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 158 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVSAIRDAIRSHPAVREIFEYDIPFAKCYLIDKGPVPMTGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 159 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVDPIVGYRFCKDFKGFIPSILEDLIETRQKVKRKMKATIDPIEKKMLDYRQRSLKILANSYAGYQGYPKARWYSLECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 160 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRMEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 161 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 162 - protein, 773 aa, synthetic construct
  REGION 1..773: note = Description of Artificial Sequence: Synthetic polypeptide
MILDTDYITENSKPVIRIFKKEKGEFKIEYDRNFEPYIYALLEDDESIGDIKKITGERHGKKVRIIRVEKVKKKFLGEPIEVWKLVFEHPQDMPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 163 - protein, 773 aa, synthetic construct
  REGION 1..773: note = Description of Artificial Sequence: Synthetic polypeptide
MILDTDYITENGKPVIRIFKKEKGEFKIEYDRNFELYIYALLEDDESIEDIKKITGERHGKKVRIIRVEKVKKKFLGEPIEVWKLVFEHPQDVPAICDAIRSHPAVRENFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 164 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 165 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHLQDVPVIRDAIRSHPAVREIFEYDILFAKRYLIDKGLVPMDGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 166 - protein, 773 aa, synthetic construct
  REGION 1..773: note = Description of Artificial Sequence: Synthetic polypeptide
MILDTDYITENGKPVIRIYKKEKGEFKIEYDRNFEPYIFALLEDDESIEDIKKITGERHGKKVRIIRVEKVKKEFLGEPIEVWKLVFEHPQDVPAIRDAIRSHPAAREIFEYDIPFAKRYLIDKGLVPMEGGEELELLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 167 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYYGYQGYPKARWYSLECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 168 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 169 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 170 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLKDDESIEDIKKITGERHGKKVRIIRVEKVKKRFLGEPIEVWKLVFEHPQDVPAIRDAIRSHPAVREIFEYDIPFAKRYLIDKGLVPMEGGEEQKLPAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 171 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYNGYQGYPKARWYSLECAESVTAWGRHYTETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHKQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 172 - protein, 773 aa, synthetic construct
  REGION 1..773: note = Description of Artificial Sequence: Synthetic polypeptide
MILDTDYSTENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 173 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 174 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKRFLGEPNEVWKLVFEHLQDVPAIRDAIRSHPAVREIFEYDIPSAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 175 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRDAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 176 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVERYLLRVAYERNELAPNKPGGEEYQRRMRSSYIGGYVKEPEKSLWESIAYLDFRSSAGSIIVTHNVSPDTLEKECKNYDVVPIVGYHFCKDFKGFIPSILEDLIETRQKVKRKMKATIDPVEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 177 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSGASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 178 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIRTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 179 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 180 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 181 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGRVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 182 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFAMEVELAKLIGQSVWDVSRSSTGNMVEWYLLRVAYERNELAPNKPGGEEYQRRMRSSYIGGYVKEPEKGLWESITYLDFRSSAGSIIVTHNVSPDTLEKGYKNYDVAPTVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 183 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKVSDRVILFDEYESSRHKYDPDYYIHNQVLPAVLRILEAFGYKEKDLEYQRMKQTGLSAWLKMGKK

SEQ ID NO: 184 - protein, 773 aa, synthetic construct
  REGION 1..773: note = Description of Artificial Sequence: Synthetic polypeptide
MILDTDYITENGKPVIRIFKKEKGEFMIEYDRNFEPYIYALLEDVESIEDIKKITGECHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 185 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIARETQAKVLELILREGSIEKAAGFVKKVVEDLANYRVPIEKLIIHEQVTRELKDYKATGPHVAIAKRLQARGIKVKPGTIISYVVLKGNKKISDRVILFDEYDSSRHKYDPDYYIHNQVLPAVLRILEAFGYKEKDLEYQRMKQTGLGAWLKMGKK

SEQ ID NO: 186 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANGYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 187 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVLAIRDAIRSRPAVREIFEYDILFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 188 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 189 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIVTHNVSPDTLEKECKNYDVDPIVGYRFCKDFKGFIPSILEDLIETRQKVKRKMKATIDPIEKKMLDYRQRSLKILANSYAGYQGYPKARWYSLECAERVTAWGRHYHETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHKQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 190 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRRRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 191 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 192 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGNPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVAPIVGYRFCKDFKGFIPSILEDLIETRQKVKRKMKATIDPIEKKMLDYRQRSLKILANSYYGYQGYPKARWYSLECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 193 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 194 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLVDDESIEDIKKITGERHGKKVRIIRVEKVKKKFLGEPIEVWKLVFEHPQDVPAICDAIRSHPAVREIFEYDIPFAKRYLIDKGLVLMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 195 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEYAESVTAWGRHYIETTIKEAEKFGFKVLYADTDGFFATIPNEKPETIKSKAKKFLKYINEELPGMLELEYEGFYLRGFFVTKKKYALIDEDGHITTRGLEVVRRDWSEVAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 196 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 197 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYGISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 198 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 199 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGNPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 200 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 201 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKKTQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAILRILEAFGYKEKDLEYQRMKQTGLGAWLKMGKK

SEQ ID NO: 202 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVAPIVGYRFCKDFKGFIPSILEDLIETRQKVKRKMKATIDPIEKKMLDYRQRSLKILANSYAGYQGYPKARWYSLECAERVTAWGRHYTETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHKQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 203 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLKVILREGSIEKAAGIVKKVVEDLANYRVPVEKLIIVEQITRGLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 204 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 205 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGNPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVDPIVGYRFCKDFKGFIPSILEDLIETRQKVKRKMKATIDPIEKKMLDYRQRSLKILANSYAGYQGYPKARWYSLECAERVTAWGRHYIETTIKEAEKFGFKVLYADTDGFFATIPNEKPETIKSKAKKFLKHINEKLPGMLELEYEGFYLRGFFVTKKQYALIDEDGHITTRGLEVVRRDWSEIAKETQAKVLEVILREGSIEKAAGIVKKVVEDLANYRVPVEKLIIHKQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 206 - protein, 773 aa, synthetic construct
  REGION 1..773: note = Description of Artificial Sequence: Synthetic polypeptide
MILDTDYITENGKPVIRIYKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKHYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 207 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 208 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 209 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSSIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 210 - protein, 773 aa, synthetic construct
  REGION 1..773: note = Description of Artificial Sequence: Synthetic polypeptide
MILDTDYITVNGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 211 - protein, 773 aa, synthetic construct
  REGION 1..773: note = Description of Artificial Sequence: Synthetic polypeptide
MILDTDYITENGEPVIRIFKKEKGEFKIEYDRNFEPYIYALLEDDESIEDIKKITGERHGKKVRIIRVEKVKKKFLGEPIEVWKLVFEYPQDVPAIRDAIRSHPAVREIFEYDIPLAKRYMIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 212 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGLHVAIAKHLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 213 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPFEVWKLVFEHPQDVPAIRDAICSHPAVREIFEYDISFAKRYLIDKGLVPMDGGEELKLLAFAVATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 214 - protein, 773 aa, synthetic construct
  REGION 1..773: note = Description of Artificial Sequence: Synthetic polypeptide
MILDTDYITENGKPVIRIFKKEKGEFKIEYDRNFELYIYALLEDDESIEVIKKITGERHGKKVRIIRVEKVKKKFLGEPIEVWKVVLEHPQDVPAIPDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 215 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIICVEKVKKKFLGEPNEVWKLVFEHPQDAPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 216 - protein, 773 aa, synthetic construct
  REGION 1..773: note = Description of Artificial Sequence: Synthetic polypeptide
MILDTDYITENGKPVIRIFKKEKGEFKIEYDRNFDPYIYALLEDDESIEDIKKITGECHGKKVRIIRVEKVKKKFLGKPNEVWKLVFEHSQDVPAIRDAIRSHPAVREIFEYDIPFAKRYLIDKGLVPMKGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 217 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYQDFRSSAGSIIVTHNVSPDTLEKECKNYDVAPIVGYRFCKDFKGINPSILEDLIETRQKVKRKMRATIVPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 218 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIRTHNVSPDTLEKECKNYDVAPIVGYRFCKDFKGFIPSILEDLIETRQKVKRKMKATIDPIEKKMLDYRQRSLKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 219 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVIEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 220 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 221 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATSPHVAIAKRLQARGIKVKPGTIISYVVLKGSKKISDRVILFDEYDSSRHKYDPDYYIHNQVLPAVLRILEVFGYKEKDLEYQHMKQTGLGAWLKMGKK

SEQ ID NO: 222 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGNPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVDPIVGYRFCKDFKGFIPSILEDLIETRQKVKRKMKATIDPIEKKMLDYRQRSLKILANGYYGYQGYPKARWYSLECAESVTAWGRHYHETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHKQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 223 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 224 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 225 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 226 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVFLREGSIEKATGIVKKVVEDLANYRVPVEKLIIHEQITRELKDYKATGPHVAIAKRLQARGIKVKPGTIISYVVLKGSKKISDRVILFDEYDSSRHKYDPDYYIHNHVLPAVLRILEVFGYNEKDLEYQRMKQTGLGAWLKMGKK

SEQ ID NO: 227 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 228 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKEVRIIRVEKVKKKFLGEPIEVWKLVFEHPQDAPAIRDAIRSHPAVREIFEYDIPFAKRYLIDKGLVPVEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSESKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 229 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVGDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 230 - protein, 773 aa, synthetic construct
  REGION 1..773: note = Description of Artificial Sequence: Synthetic polypeptide
MILDTDYITENGKPVIRIFKKEKSEFKIEYDRNFEPYIYALLEDDESIEDIKKITGELHGKKVRIIRVEKVKKKFLGEPIEVWKLVFEHPQDVPAIRDAIRSHPAVREILEYDIPFAKHYLIDKGLVPIEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 231 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 232 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGNPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVAPIVGYRFCKDFKGFIPSILEDLIETRQKVKRKMKATIDPIEKKMLDYRQRSLKILANSYAGYQGYPKARWYSLECAESVTAWGRHYHETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 233 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANGYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 234 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVDRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVIPFDEYDSSRHKYDPDYYIHNQVLPAVLRILEAFGYKEKDLEYQRMKQTGLGAWLKMGKK

SEQ ID NO: 235 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKISSECHGKKVRIIRVEKVKKKFLGEPIEVWKLVFEHPQDVPAIHDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 236 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFAKRYLIDKGLVPLEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 237 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIVTHNVSPDTLEKECKNYDVDPIVGYRFCKDFKGFIPSILEDLIETRQKVKRKMKATIDPIEKKMLDYRQRSLKILANSYYGYQGYPKARWYSKECAESVTAWGRHYHETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 238 - protein, 773 aa, synthetic construct
  REGION 1..773: note = Description of Artificial Sequence: Synthetic polypeptide
MILDTDYITENGKPVIRIFKKEKGEFKIEYDRNFEPNIYALLEDDEGIEDIKKITGERHGKKVRIIRVEKVKKKFLGEPIEVWKLVFEHPQDVPAIHDAIRSHPAVREIFEYDIPFARRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 239 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRNYNETTIKEAEKFGFKVLYADTDGFFATFPNEKPETIKSKAKKFLKHINEKLPGMLELEYEGFYLRGFFETKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 240 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIKTHNVSPDTLEKECKNYDVDPIVGYRFCKDFKGFIPSILEDLIETRQKVKRKMKATIDPIEKKMLDYRQRSLKILANSYAGYQGYPKARWYSLECAESVTAWGRHYTETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHKQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 241 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIRTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 242 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKESQAKVLEVILREGSIEKAAGIVKKVVEDLANYRVPVEKLIIHEQITRGLKDYKATGPHVAIAKRLQARGIKVKPGTIISYVVPKGSKKISDRVILFDKYDSSRHKYDPDYYIHNQVLPAVLRILEAFGYKEKDLEYLRMKQTGLGAWLKMGKK

SEQ ID NO: 243 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 244 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPADVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 245 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKQCAKSVTAWGRHYIETTIKEAEKFGFKVLYADTDGFFATTPNEKPETIKSKAKKFLKHINEKLPGMLELEYEGFYLRGFFVTKKKYALIDEDGRITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 246 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYIATGPHVAIAKRLQARGIKVKPGTIISYVVLKGSKKISDRVILFDEYDCSRHKYDPDYYIHNQALPAVLRILEAFGYKEKDLEYQRMKQTGLGAWLKMGKK

SEQ ID NO: 247 - protein, 773 aa, synthetic construct
  REGION 1..773: note = Description of Artificial Sequence: Synthetic polypeptide
MILDTDYITENGKPVTRIFKKEKGEFKIEYDRNFEPYIYALLEDDESIEDIKKITGERHSKKVRTIRVEKVKKKFLGEPIEVWKLVFEHPQDVPAIRDTIRNHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 248 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVRKKFLGEPIEVWKLVFEHPQDVPVIRDAIRSHPAVCEIFVYDISFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 249 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 250 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIVTHNVSPDTLEKECKNYDVAPIVGYRFCKDFKGFIPSILEDLIETRQKVKRKMKATIDPIEKKMLDYRQRALKILANSYYGYQGYPKARWYSLECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 251 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHDQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 252 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSRIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 253 - protein, 773 aa, synthetic construct
  REGION 1..773: note = Description of Artificial Sequence: Synthetic polypeptide
MILDTDYITENGKPVIRIFKKEKGEFKIEYDRNFEPYNYALLEDDESIEDIKKITGERHGKKVRIIRVEKVKKKFLGEPIEVWKLVFEHPQDVPVIRDAIRSHPAVREIFEYDIPFAKRYLFDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 254 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVQAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 255 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKIKKKFLGEPIEVWKLVFEHPQDVPAIRDAIRSHPAVREIFEYDIPFAKRYLFDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 256 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIRTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYTETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 257 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 258 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 259 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYGGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 260 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVDPIVGYRFCKDFKGFIPSILEDLIETRQKVKRKMKATIDPIEKKMLDYRQRSLKILANSYYGYQGYPKARWYSKECAESVTAWGRHYTETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHKQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 261 - protein, 773 aa, synthetic construct
  REGION 1..773: note = Description of Artificial Sequence: Synthetic polypeptide
MILDTDYITENGKPVIRIFKKEKGEFKIEYDRNFEPYIYVLLEDDESIEDIKKITGERHGKKVRIIRVEKVKKKFLGEPIEVWKLVFEHPQDVPAIRDAIRSHPAVREIFEYDIPFAKSYLIDKGLVPMEGGEELRLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 262 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKCLGEPIEVWKLVFEHPQVVLAIRDAIRSHPAVREIFEYDIPFAKRCLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 263 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 264 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 265 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIDQSVWDVSRSSTGNLVEWYLLRVAYERNELAPNKPGGEKYQRRMRSSYIGGYVKEPEKGLWESIAYLDFRSSAGSIIVTHNVSPDTLEKECKNYDVAPIVGYRFCKDFKGFFPNILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 266 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIGKAAGIVKKVVEDLANYRVPVEKLIIHEQITRELKDYKATGPHVAIAKRLQARGIKVKPGTIISYVVLKGSKKISGRVILLDEYVSSRHKYDLDHYIHNQVLPAVLRILEAFGYKEEDLEYQRMKQNGLGAWLKMGKK

SEQ ID NO: 267 - protein, 773 aa, synthetic construct
  REGION 1..773: note = Description of Artificial Sequence: Synthetic polypeptide
MILDTDYITENGKPVIRIFKKEKGEFKFEYDRNFEPYIYALLEDDESIEDIKKITGERHGKKVRIIRVEKVKKKFLGEPIEVWKLVFEHPQDVPAIRDAIRSHPAVREIFEYDIPFAKRYLFDKGLVPMEGGEEMKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 268 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGCIEKAAGIVKKIVEDLANYCVPVEKLIIHEQITRELKDYKATGPHVAIAKRLQARGIKVKPGTIISYVVLKGSKKISDRVILFDEYDSSRHKYDPDYYIHNQALPAVLRILEAFGYKEKDLEYQRMKQTGLGAWLKMGKK

SEQ ID NO: 269 - protein, 773 aa, synthetic construct
  REGION 1..773: note = Description of Artificial Sequence: Synthetic polypeptide
MILDTDYITENGKPVFRIFKKEEGEFKIEYDRNFEPYIYAPLEDDESIKDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 270 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLENDERIEDIKKITGERHGKKVRIIRVEKVKKKFLGEPIEVWKLVIEHPQDVPAIRDAIRSHPAVREIFEYDIPFAKRNLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 271 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 272 - protein, 773 aa, synthetic construct
  REGION 1..773: note = Description of Artificial Sequence: Synthetic polypeptide
MILNTDYITENGKPVIRIFKKEKGEFKIEYDRNFEPYIYALLEDDESIEDIKKITGERHGKKVRIIRVEKVKKKFLGEPIEVWKLVFEHPQDVPVIRDAIRSHPAVREIFEYDIPFAKHYLIDKGLVPMEGGEELKLLAYAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 273 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDVNIEDIKKITGGRHGKKVRIIRVEKVKKKFLGEPIEVWKLVFEHPHDVPAIRDAIRSHPAVREKFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 274 - protein, 773 aa, synthetic construct
  REGION 1..773: note = Description of Artificial Sequence: Synthetic polypeptide
MILDTDYITENGKPVTRIFKKEKGEFKIEYDRNFEPYIYALLEDDESIEDIKKITGERHGKKIRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 275 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIIIYVVLKGSKKISDRVILFDEYDSSRHKYDPDYYIHNQVLPAVLRILEAFGYKEKDLECQRMKQTGLGAWLKMGKK

SEQ ID NO: 276 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 277 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGSVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 278 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 279 - protein, 773 aa, synthetic construct
  REGION 1..773: note = Description of Artificial Sequence: Synthetic polypeptide
MILDTDYITENGKPVIRIFKKEKGEFKIEYDRNFELYIYALLEDDESIEDIKKITGERHGKKVRIIRVEKVKKKFLGEPIEVWKLVFEHPQDVPAIRDAIRSHPAVREIFEYDIPFAKRYLIDKGLVPMGGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 280 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEVLANYRVPVEKLIIHEQITRKLKDYKVTGPHVAIAKRLQARGIKIKPGTIISYVALKGSKKISDRVILFDEYDSSRHKYDPDYYIHNHVLPAVLRILEAFGYKEKDLEYQRMKQTGLGAWLKMGKK

SEQ ID NO: 281 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGGRHGKKVRIIRVEKVKKKFLGEPIEVWKLVFEHPQDVPAILDAIRSHPAVREIFEYYIPFAKRYLIDKGLVPMKGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 282 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAICSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 283 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDYRSSAGNIIVTHNVSPDTLEKECKNYDVAPIVGYRFCKDFKGLIPSILEDLIETRQKVKRKMKATIDPFEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 284 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 285 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVFQREGSIEKAAGIIKKVVEDLANYRVPVEILIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 286 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGSLVEWYLLRVAYERNELAPNKPGGEEYQRRIRSSYIGGYVKEPEKGLWESIAYLDFRSSAGSIIVTHNVSPDTLEKECKNYDVAPIVGYRFCKDFKGFILSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 287 - protein, 773 aa, synthetic construct
  REGION 1..773: note = Description of Artificial Sequence: Synthetic polypeptide
MILDTDYITENGKPVIRIFKKEKGELKIEYDRNFEPYTYALLEDDESIEDIKKITGERHGKKVRIIRVEKVKKKFLGEPIEVWKLIFEHPQDVPAIRDAICSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 288 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 289 - protein, 773 aa, synthetic construct
  REGION 1..773: note = Description of Artificial Sequence: Synthetic polypeptide
MILDTDYITENGKPVIRIFKKEKGEFKIDYDRNFEPYIYALLEDDESIEGIKKITGERHGKKVRIIRVEKIKKKFLGEPIEVWKLVFEHPQDEPAIRDAIRSLPATREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 290 - protein, 773 aa, synthetic construct
  REGION 1..773: note = Description of Artificial Sequence: Synthetic polypeptide
MILDTDYITENGKPVIRIFMKEKGEFKIEYDRNFELYIYGLLEDDESIEDIKKITGERHGKNVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 291 - protein, 773 aa, synthetic construct
  REGION 1..773: note = Description of Artificial Sequence: Synthetic polypeptide
MILDTRYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 292 - protein, 773 aa, synthetic construct
  REGION 1..773: note = Description of Artificial Sequence: Synthetic polypeptide
MILDTDYITENGKPVIRIFKKEKGEFKIEYDRNSEPYIYALLEDVESIEDIKKIAGERHGKKVRIIRVEKVKKKFLGEPIEVWKLVFEHPQDVPAIRDAIRSHPAVREIFEYDIPFAKRYLFDKGLVPMEGSEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 293 - protein, 773 aa, synthetic construct; identical to SEQ ID NO: 245
  REGION 1..773: note = Description of Artificial Sequence: Synthetic polypeptide

SEQ ID NO: 294 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 295 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDMPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 296 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 297 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 298 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTINLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 299 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWEVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 300 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 301 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEVLANYRVPVEKLIIHEQITRELKDYKATGPHVAIAKRLQARSIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 302 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSNEKAAGIVKKVVEDLANYRVPVEKLIIHEQITRELKDYKATGPHVAIAKRLQARGIKVKPGTIISYVVLKGSKRISDRVILFDEYDSGRHKYDPDYYIHNQVLPAVLRILEAFGYKEKDLEYQRMKQTGLGAWLKMGKK

SEQ ID NO: 303 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVQRILEAFGYKEKDLEYQRMKQTGLGAWLKMGKK

SEQ ID NO: 304 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYELEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 305 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDFRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 306 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLTNYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 307 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 308 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILVAFGYKEEDLEYQRMKQTGLGAWLKMGKK

SEQ ID NO: 309 - protein, 772 aa, synthetic construct
  REGION 1..772: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLYQRMKQTGLGAWLKMGKK

SEQ ID NO: 310 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 311 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 312 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEGWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 313 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTEGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 314 - protein, 756 aa, synthetic construct
  REGION 1..756: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQFTRELKDYKATGPHVAIAKRLQARGIKVKPGTIISYVVLKGSIKVSDRVILFDEYDGSRHKYDPDYYIHNQVLPAVLRILEAFGYKEKDLEY

SEQ ID NO: 315 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 316 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIKKAAGIVKKVVEDLANYRMPVEKLIIHEQITRELKDYKATGPHVAIAKRLQARGIKVKPGTIISYVVLKGGKKISDRVILFDEYDSSRHKYDPDYYIHNRVLPAVLRILEAFGYKEKDLEYQRMKQTGLGAWLKMGKK

SEQ ID NO: 317 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 318 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEAARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 319 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYAETDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 320 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDARQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 321 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYAATDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 322 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSNKISDRVILFDEYDSSRHKYDPDYYIHNQVLPAVLRILEAFGYKEKDLEYQRMKQTGLGAWLKMGKK

SEQ ID NO: 323 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDVRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 324 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKKTQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 325 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 326 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 327 - protein, 757 aa, synthetic construct
  REGION 1..757: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQ

SEQ ID NO: 328 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRWDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 329 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDTPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 330 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTWNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 331 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 332 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMSDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 333 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDVRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 334 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 335 - protein, 773 aa, synthetic construct
  REGION 1..773: note = Description of Artificial Sequence: Synthetic polypeptide
MILATDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWAVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 336 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNEDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 337 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 338 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDTPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 339 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 340 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 341 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLLARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 342 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGSLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 343 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDHFAVEVKGRIHLDLAPVVRHTIRLSTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 344 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 345 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILHEGSIEKAAGIVKKVVEDLANYYVPVEKLIIHEQITRELKDYKATGPHVAIAKRLQARGIKVKPGTIISYVVLKGSKKISDRVILFDEYDSGRHKYDPDYYTHNHVLPAVLRILEAFGYKEKDLEYQRMKQTGLGAWLKMGKK

SEQ ID NO: 346 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAIVLEVILREGSIEKAADIVKKVVEDLANYRVPVEKLIIHEQITRELKDYKASGPHVAIAKRLQARGIKVKPGTIISYVVLKGSKKISDRVILFDEYDSSRHKYDPDYYIHNRVLPAVLRILEAFGYKEKDLEYQRMKQTGLGAWLKMGKK

SEQ ID NO: 347 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGVKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 348 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDTRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 349 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPPDAPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 350 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 351 - protein, 773 aa, synthetic construct
  REGION 1..773: note = Description of Artificial Sequence: Synthetic polypeptide
MILDTDYITENGKPVIRIFKKEKGEFKIEYDRNFEGYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 352 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 353 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVATARRLQARGIKVKPGTIISYVVLKGSKKISDRVILFDVYDSSRHKYDPDYYIHNQVLPAVLRILEAFGYKKKDLEYQRMKQTGLGAWLKMGKK

SEQ ID NO: 354 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEFYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 355 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELRRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 356 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 357 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVIEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 358 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTISLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 359 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 360 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 361 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 362 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTENGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 363 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 364 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDARQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 365 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 366 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLEPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 367 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGSIISYVVLKGSKKISDRVILFDEYDSSRHKYDPDYYIHNQVLPAVLRILEAFGYKEKDLEYQRMKQTGLGAWLKMGKK

SEQ ID NO: 368 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVREDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 369 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDARQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 370 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 371 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKLIIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 372 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLRVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGPKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 373 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 374 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIIKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 375 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 376 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANCRVPVEKLIIHEQITRGLKDYKASGPHVAIAKRLQARGVKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 377 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 378 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPYYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 379 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKASGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 380 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFARRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 381 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 382 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYYSSRHKYDPDYYIHNQVLPAVLRILEAFGYKEKDLEYQRMKQTGLGAWLKMGKK

SEQ ID NO: 383 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNADFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 384 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDARQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 385 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDFKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 386 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 387 - protein, 773 aa, synthetic construct; identical to SEQ ID NO: 303
  REGION 1..773: note = Description of Artificial Sequence: Synthetic polypeptide

SEQ ID NO: 388 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYAGTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 389 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGNSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 390 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNSDNFDFAYIKKRCEKLGLKFTIGRDGSEPKIQRMDDRFVVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 391 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREDSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 392 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 393 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 394 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDYFDFAYIKKRCEKLGPKFTIGRDGSEPKIQRMGDRFAVEVKGRIHLDLAPVVRHTIRLPTYTLEAVYEAVFGKKKEKVYAEEIAEAWKSEEGLKRVAQYSKEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 395 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 396 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 397 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 398 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTPEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 399 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 400 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTMEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 401 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHMQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 402 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 403 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHRQVLPAVLRILEAFGYKEKDLEYQRMKQTGLGAWLKMGKK

SEQ ID NO: 404 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 405 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFEEEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 406 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIIKKVVEDLANYRVPVEKLIIHEQITRELKDYKATGPHMAIAKRLQARSIKVKPGSIISYVVLKGSKKISDRVILFDEYDSSRHKYDPDYYIHNQVLPAVLRILEAFGYKEKDLEYQRMKQTGLGAWLKMGKK

SEQ ID NO: 407 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELRDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 408 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVKRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 409 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 410 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECRNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 411 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPAAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 412 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 413 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFEHEGDEFAEGEILMISYADESGAKVITWKKIDLPYVEVVSTEREAIKRFLQVLREKDPDVLLTYNGDNADFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 414 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFEHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 415 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 416 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 417 - protein, 773 aa, synthetic construct
  REGION 1..773: note = Description of Artificial Sequence: Synthetic polypeptide
MILDTSYITENGKPVIRIFKKEKGEFKIEYDSNFEPYIYALLEDDESIEDIKKITGERHGKKVRIIRVEKVKKKFLGEPIEVWKLVFEHPQDVPAIRDAIRSHPAVREIFEYDISFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 418 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 419 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQEMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 420 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQASGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 421 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKINRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 422 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLKLEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 423 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKMVEDLANYRVPVEKLIIHEQITRELKDYKATGPHVAIAKRLQARGIKVKPGTIISYVVLEGSKKISDRVILFDEYDSSRHKYDPDYYIHNQVLPAVLRILEAFGYKEKDLEYQRMKQTGLGAWLKMGKK

SEQ ID NO: 424 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDWRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 425 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 426 - protein, 772 aa, synthetic construct
  REGION 1..772: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 427 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGLHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 428 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFEHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 429 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRWDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 430 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEQVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 431 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDALLTYNGDNFDFAYIKKRCEKLGLKFTIGRDGSEPKIQRMGDRFAVEVKGRIHLDLAPVVRHTIRLPTYTLKAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 432 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 433 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 434 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKENVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 435 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRTSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 436 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEFYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 437 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYEEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 438 - protein, 773 aa, synthetic construct
  REGION 1..773: note = Description of Artificial Sequence: Synthetic polypeptide
MILATDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVAVKGRIHLDLAPVVRHTIRLPTYTLEAVYEAVFGKKKEKVYAEEIAEAWKSEEGLKRVAQYSMEDARATYELGREFFPMEVELAKLIGQSVWRVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 439 - protein, 773 aa, synthetic construct
  REGION 1..773: note = Description of Artificial Sequence: Synthetic polypeptide
MILDTDYITENGKPVIRIFKKEKGEFKIEYDRNFEMYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 440 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKRISDRVILFDEYDSSRHKYDPDYYIHNQVLPAVLRILEAFGYKEKDLEYQRMKQTGLGAWLKMGKK

SEQ ID NO: 441 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 442 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDARQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 443 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARSIKVKPGTIISYVVLKGSKKISDRVILFDEYDSSRHKYDPDYYIHNQVLPAVLRILEAFGYKEKDLECQRMKQTGLGAWLKMGKK

SEQ ID NO: 444 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDVRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 445 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYFHNQVLPAVLRILEAFGYKEKDLEYQRMKQTGLGAWLKMGKK

SEQ ID NO: 446 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRKGDRFAVEVKGRIHLDLAPVIRHTIRLPTYTLEAVYEAVFGKKKEKVYAEEIAEAWKSEEGLKRVAQYSLEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 447 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYVKKRCEKLGLKFTIGRDGSEPKIQRMGVRFAVEVKGRIHLDLVSVVRHSIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 448 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDWRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 449 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPAEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 450 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDARQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 451 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDISFAKRYLIDKGLVPMEGGEELKLLAFDIETFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 452 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRIILFDEYDSSRHKYDPDYYIHNQVLPAVLRILEAFGYKEKDLEYQRMKQTGLGAWLKMGKK

SEQ ID NO: 453 - protein, 772 aa, synthetic construct
  REGION 1..772: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 454 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFKSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 455 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDFRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 456 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHIDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 457 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVKDLANYRVPVEKLIIHEQIARELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 458 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVFLREGSIEKAAGIVKKVVEDLANYRVPVEKLIIHEQITRELKDYKATGPHVAIAKRLQARGIKVKPGTIISYVVLKGSKKISDRVILFDEYDSSRHRYDPDYYIHNQVLLAVLRILEAFGYKEKGLEYQRMKQTGLGAWLKMGKK

SEQ ID NO: 459 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 460 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLWPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 461 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLHEKDPDVLLTYNGDNFDFAYIKKRCEKLGLKFIIGRDGSEPKIQRMGDRFAVEVKGRIHLDLAPVVRHTIRLPTYTLEAVYEAVFGKKKEKVYAEEIAEGWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 462 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 463 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 464 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEEVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 465 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGEHHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 466 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFARRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 467 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATFELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 468 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKGSGISAMKQTGLGAWLKMGKK

SEQ ID NO: 469 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFEHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYELEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 470 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 471 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVERDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 472 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTPEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 473 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWAVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 474 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGLHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 475 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDISFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 476 - protein, 773 aa, synthetic construct
  REGION 1..773: note = Description of Artificial Sequence: Synthetic polypeptide
MILDTDAITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 477 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGVVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 478 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCVKLGLKFTIGRDGSEPKIQRMGDRFAVEVKGRIHQDLAPVVRHTIRLPTYTLEAVYEAVFGKKREKVYAEEIAEAWKSEEGLKRVAQYSMEDARATYELGREFFPMEVKLAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 479 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDYFDFAYIKKRCEKLGLKFTIGRDGSEPKIQRMGDRFAVEVKGRIHLDLAPVVRHTIRLPTYSLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 480 - protein, 773 aa, synthetic construct; identical to SEQ ID NO: 456
  REGION 1..773: note = Description of Artificial Sequence: Synthetic polypeptide

SEQ ID NO: 481 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYTEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 482 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWNVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 483 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEEVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 484 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDKPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 485 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGQLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 486 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSVEKAAGIVKKVVEDLANYRVPVEKLIIHEQITRELKDYKATGPHVAIAKRLQARGIKVKPGTIISYVVLKGSKKFSDRVILFDEYDSSRHKYDPDYYIHNQVLPAVLRILEAFGYKEKDLEYQRMKQTGLGAWLKMGKK

SEQ ID NO: 487 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 488 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 489 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFAHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 490 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGFPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 491 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYWLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 492 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEENAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 493 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYNEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 494 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDWRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 495 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVSRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 496 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDVRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 497 - protein, 773 aa, synthetic construct
  REGION 1..773: note = Description of Artificial Sequence: Synthetic polypeptide
MILDTDYITENGKPVIRIFKKEKGEFKIEYDRNFEPFIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 498 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHMAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 499 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPAYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 500 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDEFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 501 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKRGTIISYVVLKGSKKISDCVILFDEYDSSRHKFDPDYYIHNQVLPAVLRILEAFGYKEKDLDYQRMKQTGLGAWLKMGKK

SEQ ID NO: 502 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGFPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 503 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDTRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 504 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEEARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 505 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDTRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 506 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFEHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEAARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 507 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKAIGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 508 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPVYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 509 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNWDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 510 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPLYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 511 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 512 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPKDAPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 513 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 514 - protein, 773 aa, synthetic construct
  REGION 1..773: note = Description of Artificial Sequence: Synthetic polypeptide
MILRTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVAVKGRIHLDLAPVVRHTIRLPTYTLEAVYEAVFGKKKEKVYAEEIAEAWKSEEGLKRVAQYSMEDARATYELGREFFPMEVELAKLIGQSVWAVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 515 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYVDTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 516 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSGIAKETQAKVLEVILREGSIEKAAGIVKKVVEDLANYRVPVEKLIIHEQITRELKDFKATGPHVAIAKRLQARGFKVKPGTIISYVVLKGSKKISDRVILFDEYDSSRHKYDPDYYIRNQVLPAVLRILEAFGYKEKDLEYQRMKQTGLGAWLKMGKK

SEQ ID NO: 517 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTGGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 518 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDTRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 519 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDFRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 520 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMRDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 521 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKVAGIVKKVVKDLANYRVPVEKLIIHEQITRELKDYKATGLHVAIAKRLQARGIKVKPGTIISYVVLKGSKKISDRVILFDEYDSSRHKYDPDYYNHNQVLPAVLLEAFGYKEKDLEYQRMKMKQTGLGAWLKMGKK

SEQ ID NO: 522 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFNSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 523 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHVQITRELKDYKATGPHVAIAKRLQARGIKVKPGTIISYVVLKGSKKISDRVILFDEYDSGRHKYDPDYYIHNQVLPAVLRILEAFGYKEKDLEYQRMKQTGLGAWLKMGKK

SEQ ID NO: 524 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREVIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 525 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDWRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 526 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWRVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 527 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 528 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLARVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 529 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREVIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGIKKEKVYAEEIAEAWKSEEGLKRVAQYSIEDARATYELGREFFPMEVKLAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 530 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYHVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 531 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPHDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 532 - protein, 773 aa, synthetic construct; identical to SEQ ID NO: 224
  REGION 1..773: note = Description of Artificial Sequence: Synthetic polypeptide

SEQ ID NO: 533 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 534 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 535 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 536 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDVPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 537 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEWARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 538 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 539 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPVVLRILEAFGYKEKDLEYQRMKQTGLGAWLKMGKK

SEQ ID NO: 540 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTANGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 541 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQIARELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 542 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKTYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 543 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKASGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 544 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGIFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 545 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 546 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHKQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 547 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVDHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 548 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYAATAGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 549 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVIEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFVYKEKDLEYQRMKQTGLGAWLKMGKK

SEQ ID NO: 550 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDFRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 551 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMADRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 552 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVVKLIIHEQITRELKDYKATGPHVAIAKRLQARGIKVKPGTIISYVVLKGSIKISDRVILFDEYDSSRHKYDPDYYIHNQVLPAVLRILEAFGYKEKDLEYQRMKQTGLGAWLKMGKK

SEQ ID NO: 553 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 554 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTMEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 555 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 556 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVSQYSMEDARATYELGREFFPMEVELAKLIGQSVWDVSRSSTSNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 557 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPEIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 558 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITEELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 559 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMRDDFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 560 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 561 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSGIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 562 - protein, 773 aa, synthetic construct; identical to SEQ ID NO: 452
  REGION 1..773: note = Description of Artificial Sequence: Synthetic polypeptide

SEQ ID NO: 563 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 564 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTWTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 565 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKAAGPHVAIAKRLQARGIKVKPGTIIGYVVLKGSKKISDRVILFDEYDSSRHKYDPDYYIHNQVLPAVLRILEAFGYKEKDLEYQRMKQTGLGAWLKMGKK

SEQ ID NO: 566 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFSHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 567 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIDRDGSEPKIQRTGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 568 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 569 - protein, 773 aa, synthetic construct
  REGION 1..773: note = Description of Artificial Sequence: Synthetic polypeptide
MILRTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 570 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYEATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 571 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKEYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 572 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTAGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 573 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYPRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 574 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDSDVLLTYNGDNFDLAYIKKRCEKLSLKFTIGRDGSEPKIQRMGDRFGVEVKGRIHLDLAPVVRHTIRLPTYTLEAVYEAVFGKKKEKVYAEEIAEAWKSEEGLKRAAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 575 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKAAGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 576 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 577 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 578 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQHMKQTGLGAWLKMGKK

SEQ ID NO: 579 - protein, 773 aa, synthetic construct
  REGION 1..773: note = Description of Artificial Sequence: Synthetic polypeptide
MILDTSYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 580 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNVDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 581 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGVKVKPGTIISYVVLKGSKKISDRVILFDEYDSSRHKYDSDYYIHNQVLPAVLRILEAFGYKEKDLEYQRMKQTGLGAWLKMGKK

SEQ ID NO: 582 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 583 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 584 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDKPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 585 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 586 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 587 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFEHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 588 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 589 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATFELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 590 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 591 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDVRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 592 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 593 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 594 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKVYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 595 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 596 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQWSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 597 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVIQREGSIEKAAGIVKKVVEDLANYRVPVEKLIIHEQITRELKDYKATGPHVVIAKRLQARGIKVKPGTIISYVVLKGSKKISDRVILFDEYDSSRHKYDPDYYIHNQVLPAVLRILVAFGYKEKDLEYQRMKQTGLGAWLKMGKK

SEQ ID NO: 598 - protein, 773 aa, synthetic construct
  REGION 1..773: note = Description of Artificial Sequence: Synthetic polypeptide
MILDTDFITENGKQVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDISFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 599 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVAVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 600 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 601 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 602 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDGPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 603 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 604 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARSIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 605 - protein, 773 aa, synthetic construct; identical to SEQ ID NO: 488
  REGION 1..773: note = Description of Artificial Sequence: Synthetic polypeptide

SEQ ID NO: 606 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKVTQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDSDYYIHNQVLPAVLRVLEAFGYKEKDLEYQRMKQTGLGAWLKMGKK

SEQ ID NO: 607 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDFRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 608 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTATLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 609 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDDFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 610 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDFRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 611 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDSFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 612 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVARRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 613 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRFDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 614 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 615 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEAITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 616 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELIDYKATGPHVAIAKRLQARGIKVKPGTIISYVVLKDSKKISDRVILFDEYDSSRHKYDPDYYIHNQVLPAVLRILEAFGYKEKDLEYQRMKQTGLGAWLKMGKK

SEQ ID NO: 617 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 618 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVILKGSKKISDRVILFDEYDSSRHKYDPDYYIHNQVLPAVLRILEAFGFKEKDLKYQRMKQTGLGAWLKMGKK

SEQ ID NO: 619 - protein, 773 aa, synthetic construct
  REGION 1..773: note = Description of Artificial Sequence: Synthetic polypeptide
MILATDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 620 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVKLAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 621 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 622 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYIEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 623 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHELITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 624 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLARVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 625 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITSRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 626 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLASVVRHIIHLPTYTLEAVYEAVFGKKKEKVYAEEIAEAWKSEEGLKCVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 627 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETLAKVLEVILREGSIEKAAGIVKKVVEDLANYRVPVEKLIIHEQITRELKDYKATGPHVAITKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 628 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGERFAVEVKGRIHLDLAPVARHTIRLPTYTLEAVYEAVFGKKKEKVYAEEIAEAWKNEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 629 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDSPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 630 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMRDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 631 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVTRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 632 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKDTQAKVLEVILREGSIEKTAGIVKKVVEDLASYRVPVEKLIIHEQITRELKDYKATGPHVAIAKRLQARGIKVKPGTIISYVVLIGSKKISDRVILFDEYDSSRHKYDPDYYIHNQVLPAVLCILEAFGYKEKDLEYQRMKQTGLGAWLKMGKK

SEQ ID NO: 633 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 634 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQTRGIKVKPGTIISYVVLKGSNKISDRVILFDEYDSSRHKYDPDYYIHNQVLPAVLRILEAFGYKEKDLEYQRMKQTGLGAWLKMGKK

SEQ ID NO: 635 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPYYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRWDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 636 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRGLKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 637 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFMKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 638 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 639 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYNEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 640 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 641 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHVQITRELKDYKATGPHVAIAKRLQARGIKVKPGTIISYVVLKGCKKISDRVILFDEYDSSRHKYDPDYYIHNQVLPAVLRILEAFGYKEKDLEYQRMKQTGLGAWLKMGKK

SEQ ID NO: 642 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELDYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 643 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 644 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIKLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 645 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 646 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIVLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 647 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNADFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 648 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPNDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 649 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQSRGIKVKPGTIISYVVLKGSKKISDRVILFDEYDSSRHLYDPDYYIHNQVLPAVLRILEAFGYKEKDLEYQRMKQTGLGAWLKMGKK

SEQ ID NO: 650 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 651 - protein, 773 aa, synthetic construct; identical to SEQ ID NO: 598
  REGION 1..773: note = Description of Artificial Sequence: Synthetic polypeptide

SEQ ID NO: 652 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAHIKKRCEKLGLKFTIGRDGSEPKIQRMGDRFAVEVKGRIHLDLAPVVRHTIRLPTYTLEAVYEAVFGKEKEKVYAEEIAGAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 653 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 654 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDVRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 655 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRTGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 656 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTITLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 657 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLKILEAFGYKEKDLEYQRMKQTGLGAWLKMGKK

SEQ ID NO: 658 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILVAFGYKEKDLEYQRMKQTGLGAWLKMGKK

SEQ ID NO: 659 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 660 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMERARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 661 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 662 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 663 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKDYKASGPHVAIAKRLLARSIKVKPGTIISYVVLKGSKKISDRVILFDEYDSSRHKYDPDYYIHNQVLPVVLRILEAFGYKEKDLEYQRMKQTGLGAWLKMGKK

SEQ ID NO: 664 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 665 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNVDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 666 - protein, 619 aa, synthetic construct
  REGION 1..619: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEVAK

SEQ ID NO: 667 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 668 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVIMREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 669 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKFLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 670 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 671 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQASMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 672 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQESMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 673 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 674 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRWDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 675 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLNGSKKISDRVILFDEYDSSRHKYDPDYYIHNQVLPAVLRILEAFGYKEKDLEYQRMKQTGLGAWLKMGKK

SEQ ID NO: 676 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPYYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 677 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPSYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 678 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTFGRDGSEPKIQRMGDRFAVEVKGRIHLDLAPVVRHTIRLPTYTLEVVYEAVFGKKKEKVYAEEIAEAWKSEEGLKRVAQYSMEDACATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 679 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPQVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 680 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDSDYYIHNQVLPAVLRILEAFGYKEKDLEYQRMKQTGLGAWLKMGKK

SEQ ID NO: 681 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEEDLEYQRMKQTGLGAWLKMGKK

SEQ ID NO: 682 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRTGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 683 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGSIISYVVLKGSKKISDRVILFDEYDSSRHKYDPDYYIHNQVLPAVLRILEAFGYKEKDLEYQRMKQTGLGAWLKMGKK

SEQ ID NO: 684 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSSECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 685 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATFELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 686 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRRLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 687 - protein, 773 aa, synthetic construct; identical to SEQ ID NO: 412
  REGION 1..773: note = Description of Artificial Sequence: Synthetic polypeptide

SEQ ID NO: 688 - protein, 757 aa, synthetic construct
  REGION 1..757: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQ

SEQ ID NO: 689 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPVVLRILEAFGYKEKDLEYQRMKQTGLGAWLKMGKK

SEQ ID NO: 690 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEANKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 691 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIIGYVVLKGSKKISDRVILFDEYDSSRHKYDPDYYIHNQVLPAVLRILEAFGYKEKDLEYQRMKQTGLGAWLKMGKK

SEQ ID NO: 692 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYNEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 693 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVQRILEAFGYKEKDLEYQRMKQTGLGAWLKMGKK

SEQ ID NO: 694 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARSIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 695 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSGIAKETQAKVLEVILREGSIEKAAGIVKKVVEDLANYRVPVEKLIIHEQITRKLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 696 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKRISDRVILFDEYDSSRHKYDPDYYIHNQVLPAVLRILEAFGYKEKDLEYQRMKQTGLGAWLKMGKK

SEQ ID NO: 697 - protein, 757 aa, synthetic construct; identical to SEQ ID NO: 327
  REGION 1..757: note = Description of Artificial Sequence: Synthetic polypeptide

SEQ ID NO: 698 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLARVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 699 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 700 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHMAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 701 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYNEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 702 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILVAFGYKEKDLEYQRMKQTGLGAWLKMGKK

SEQ ID NO: 703 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPEIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 704 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 705 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 706 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKKKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 707 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRGLKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 708 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 709 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKTKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 710 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYNEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 711 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQASGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 712 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANMRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 713 - protein, 757 aa, synthetic construct
  REGION 1..757: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQ

SEQ ID NO: 714 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKKKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 715 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRGLKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 716 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 717 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSSECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 718 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKTKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 719 - protein, 757 aa, synthetic construct
  REGION 1..757: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKDYKATGPHVAIAKRLQARGIKVKPGTIISYVVLKGSKKISDRVILFDEYDSSRHKYDPDYYIHNQVLPAVLRILEAFGYKEKDLEYQ

SEQ ID NO: 720 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 721 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEEDLEYQRMKQTGLGAWLKMGKK

SEQ ID NO: 722 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLLARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 723 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGVKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 724 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHELITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 725 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANLRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 726 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALMILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 727 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVWAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 728 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIYTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 729 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRMDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 730 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFNASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 731 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIMPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 732 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSGIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 733 - protein, 773 aa, synthetic construct
  REGION 1..773: note = Description of Artificial Sequence: Synthetic polypeptide
MILDTDYITESGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 734 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 735 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRGDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 736 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 737 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSGPSIIVTHNVSPDTLEKECKNYDVAPIVGYRFCKDFKGFIPSILEDLIETRQKVKRKMKATIDPIEKKMLDYRQRALKILANSIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 738 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIKTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 739 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHGQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 740 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFMLSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 741 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFDLSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 742 - protein, 615 aa, synthetic construct
  REGION 1..615: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWS

SEQ ID NO: 743 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANSIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 744 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 745 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRSLKILANSIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 746 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRTLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 747 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFMASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 748 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFDPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 749 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVEVAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 750 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLGGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 751 - protein, 464 aa, synthetic construct
  REGION 1..464: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVK

SEQ ID NO: 752 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFNIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 753 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLVNYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 754 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHAQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 755 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSRIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 756 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSNAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 757 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFFPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 758 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKKTGERHGKKVRIIRVEKVKKKFLGEPIEVWKLVFEHPQDVPAIRDAIRSHPAVREIFEYDIPFAKRYLIDKGLVPMEGGEELKLPAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 759 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 760 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 761 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRSWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 762 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKKYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 763 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSYPSIIVTHNVSPDTLEKECKNYDVAPIVGYRFCKDFKGFIPSILEDLIETRQKVKRKMKATIDPIEKKMLDYRQRALKILANSIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 764 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFTLSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 765 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPFYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 766 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIITTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 767 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRFDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 768 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVFPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 769 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDWFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 770 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDTRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 771 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAILTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 772 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVDPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 773 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 774 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 775 - protein, 773 aa, synthetic construct
  REGION 1..773: note = Description of Artificial Sequence: Synthetic polypeptide
MILDTDYITKNGKPVIHIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFCHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 776 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 777 - protein, 773 aa, synthetic construct
  REGION 1..773: note = Description of Artificial Sequence: Synthetic polypeptide
MILDTDYITENGKPVIRIFKKEKGEFKIEYDRNFEAYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 778 - protein, 773 aa, synthetic construct
  REGION 1..773: note = Description of Artificial Sequence: Synthetic polypeptide
MILDTDYITENGKPVIRIFKKEMGEFKIEYDRNFEPYIYALLEDDESIEDIKKITGERHGKKVRIIRMEKVKKKFLGEPIEVWRLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 779 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRPLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 780 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVHKKFLGEPIEVWKLVFEHPQDVPAIRDAIRSHPAVREIFEYDIPFAKHYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 781 - protein, 773 aa, synthetic construct; identical to SEQ ID NO: 497
  REGION 1..773: note = Description of Artificial Sequence: Synthetic polypeptide

SEQ ID NO: 782 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFLPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 783 - protein, 773 aa, synthetic construct
  REGION 1..773: note = Description of Artificial Sequence: Synthetic polypeptide
MILDTDYITENGKPVIRIFKKEKGEFKIEYDRSFEPYIYVLLEDDESIEDIKKITVERHGKKVRIIRVEKVKKKFQGEPIEVWKLVFEHPQDVPAIRDAIRSYPAVREIFEYDIPFAKRYLFDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 784 - protein, 773 aa, synthetic construct
  REGION 1..773: note = Description of Artificial Sequence: Synthetic polypeptide
MILDTDYITENGKPVIRIFKKEKGEFKIEYDRNFEPNIYALLEDDESIEDIKKITGERHGKKVRIIRVEKVKKKFLGEPIEVWKLVIEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 785 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDISFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSRIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 786 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPHYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 787 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRHDWSGIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 788 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPLYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 789 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLVDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 790 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDGPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 791 - protein, 773 aa, synthetic construct; identical to SEQ ID NO: 193
  REGION 1..773: note = Description of Artificial Sequence: Synthetic polypeptide

SEQ ID NO: 792 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFYIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 793 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSQPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 794 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPLDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 795 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSGVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 796 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 797 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDVRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 798 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLLPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 799 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLALAIATFYHEGDEFAEGEILMISYADESGAKVITWKKIDLPYVEVVSTEREAIKRFLQVLREKDPDVLLTYNGDNFDFAYIKKRCEKLGLKFTIGCDGSEPKIQRMDDRFAVEVKGRIHLDLAPVIRHTIRLPTYTLEAVYEAVFGKKKGKVYAEEIAEAWKSEEGLKRVAQYSMEDARATYELGREFFPMEVGLAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 800 - protein, 773 aa, synthetic construct
  REGION 1..773: note = Description of Artificial Sequence: Synthetic polypeptide
MILDTDYITENGKPVIRIFKKEKGEFKIEYDRNFETYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 801 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIVTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 802 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRIDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 803 - protein, 773 aa, synthetic construct; identical to SEQ ID NO: 547
  REGION 1..773: note = Description of Artificial Sequence: Synthetic polypeptide

SEQ ID NO: 804 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 805 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRHDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 806 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 807 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPKYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 808 - protein, 761 aa, synthetic construct
  REGION 1..761: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQ

SEQ ID NO: 809 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 810 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTILLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 811 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVECLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 812 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRTLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 813 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDEFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 814 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANGIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 815 - protein, 463 aa, synthetic construct
  REGION 1..463: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKV

SEQ ID NO: 816 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVMRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 817 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYRATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 818 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDFRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 819 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVECLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 820 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDEVDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 821 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKDTQAKVLEVILRGGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHYQVLPAVLRILEAFGYKEKDLEYQRMKQTGLGAWLKMGKK

SEQ ID NO: 822 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRSLKILANGIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 823 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRSDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 824 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 825 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPWYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 826 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFFLSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 827 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPSEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 828 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKTLANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 829 - protein, 773 aa, synthetic construct
  REGION 1..773: note = Description of Artificial Sequence: Synthetic polypeptide
MILDTDYITVNGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKHYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 830 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSYPSIIVTHNVSPDTLEKECKNYDVAPIVGYRFCKDFKGFIPSILEDLIETRQKVKRKMKATIDPIEKKMLDYRQRALKILANGIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 831 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGGEPKIQRMGDRFAVEVKGRIHLDLAPVVRHTIRLPTYTLEAVYEAVLGKKKEKVYAEEIAEAWKSEEGLKRVAQFSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 832 - protein, 773 aa, synthetic construct
  REGION 1..773: note = Description of Artificial Sequence: Synthetic polypeptide
MILDTDYITKNGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKCYLIDKGLVPMEGGEELELLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 833 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPEYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 834 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAINTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 835 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 836 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKAYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 837 - protein, 773 aa, synthetic construct
  REGION 1..773: note = Description of Artificial Sequence: Synthetic polypeptide
MILDTSYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSRIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 838 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 839 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFFPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 840 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 841 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDWRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 842 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVEAAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 843 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 844 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLGVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 845 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFFASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 846 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFTPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 847 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFFASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 848 - protein, 773 aa, synthetic construct
  REGION 1..773: note = Description of Artificial Sequence: Synthetic polypeptide
MILDTDYITENGKPVTRIFKKEKGEFKIEYDRNFEPYIYALLEDDESIEDIKKITGERHGKKVRIIRVEKVKKKFLGEPIEVWKLVCEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 849 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSTIPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 850 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDWRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 851 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKAYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 852 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVEIAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 853 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 854 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVHKKFLGEPIEVWKLVFEHPQDVPAIRDAIRSHPAVREIFEYDIPFAKHYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 855 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDAPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 856 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 857 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDAPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 858 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIFPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 859 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFFLSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 860 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKCTQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 861 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 862 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSCIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 863 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 864 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFNPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 865 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFNLSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 866 - protein, 773 aa, synthetic construct
  REGION 1..773: note = Description of Artificial Sequence: Synthetic polypeptide
MILDTDYITENGKPVIRIFKKEKGEFKIEYDRNFEKYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 867 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSGPSIIVTHNVSPDTLEKECKNYDVAPIVGYRFCKDFKGFIPSILEDLIETRQKVKRKMKATIDPIEKKMLDYRQRALKILANGIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 868 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELSDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 869 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 870 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHELITRELRDYKATGPHVAIAKRLQARGVKVKPGTIISYVVLNGSKKISDRVILFDEYDSSRHKYDPDYYIHNQVLPAVLRILEAFGYKEKDLEYQRMKQTGLGAWLKMGKK

SEQ ID NO: 871 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILTDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 872 - protein, 773 aa, synthetic construct
  REGION 1..773: note = Description of Artificial Sequence: Synthetic polypeptide
MILDTDYITENGKPVICIFKKEKGEFKIEYDRNFEPYIYTLLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 873 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVMPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 874 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPRYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 875 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKISRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 876 - protein, 773 aa, synthetic construct
  REGION 1..773: note = Description of Artificial Sequence: Synthetic polypeptide
MILDTDYITENGKPVTRIFKKEKGKFKIEYDRNFEPYIYALLEDDESIENIKKITGERYGKKVRIIRVEKVKKKFLGEPIEVWKLVFEHPQDAPAIRDAIRSHPAVREIFEYDIPFAKRYLIDKGQVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 877 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDKPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 878 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLIPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 879 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKNYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 880 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKKYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 881 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPWEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 882 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLVDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 883 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFIASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 884 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 885 - protein, 773 aa, synthetic construct
  REGION 1..773: note = Description of Artificial Sequence: Synthetic polypeptide
MILDTDYITENGKPVIRIFKKEKGEFKIEYDRSFEPYIYALLEDDESIEDIKKITGERHGKKVRIICVEKVKKKFLGEPIVVWKLVFEHPQDVPAIRDATRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 886 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKMLANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 887 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFMLSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 888 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAPSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 889 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFLIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 890 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKMYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 891 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSYPSIIVTHNVSPDTLEKECKNYDVAPIVGYRFCKDFKGFIPSILEDLIETRQKVKRKMKATIDPIEKKMLDYRQRALKILANGYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 892 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKFTGERHGKKVRIIRVEKVKKKFLGEPFEVWKLVFEHPQDVPAIRDAIRSHPSVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 893 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFIIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 894 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILNDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 895 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRSLKILANGYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 896 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 897 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPCYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 898 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 899 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSNDPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 900 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 901 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIFTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 902 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNVDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 903 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVLEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 904 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIDPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 905 - protein, 773 aa, synthetic construct
  REGION 1..773: note = Description of Artificial Sequence: Synthetic polypeptide
MILDTDYITENGKPVIRIFKKEKSEFKIEYDRNFEPYIYALLEDDESIEDIKKITGERHGKKVRIIRVEKVKKKFLGEPIEVWKLVFEHPQDVPAIRDAIRSHPAVREIFEYDIPFAKCYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 906 - protein, 773 aa, synthetic construct
  REGION 1..773: note = Description of Artificial Sequence: Synthetic polypeptide
MILNTDYITENGKPVIRIFKKEKGEFKIEYDRNFEPYIYALLEDDESIEDIKKITGERHGKKVRIIRVEKVKKKFLSEPIEVWKLVFEHPQDVPASRDAIRSHLAVREIFEYDIPFAKRYLIDKGLMPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 907 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFMPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 908 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVYAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 909 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPNYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 910 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKCKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 911 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALRILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 912 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 913 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSRIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 914 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLRARGIKVKPGTIISYVVLKGSKKISDRVILFDEYDSSRHKYDPDYYIHNQVLPAVLRILEAFGYKEKDLEYHRMKQTGLGAWLKMGKK

SEQ ID NO: 915 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFIPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 916 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFFIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 917 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 918 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFVIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 919 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRMDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 920 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPWDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 921 - protein, 773 aa, synthetic construct; identical to SEQ ID NO: 383
  REGION 1..773: note = Description of Artificial Sequence: Synthetic polypeptide

SEQ ID NO: 922 - protein, 773 aa, synthetic construct
  REGION 1..773: note = Description of Artificial Sequence: Synthetic polypeptide
MILDTSYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSRIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 923 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDARQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 924 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPHDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 925 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKTTGPHVAIAKRLQARDIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 926 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAMYEAVFGKKKKKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 927 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKVLANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 928 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDISFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 929 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGCEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 930 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGECHGKKVRIIRVEKVKKKFLGEPIEVWKLVFEHPQDVPAIRDAIRSHPAVREFFEYDIPFAKRYLIDRGLVPMEGGKELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 931 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILDDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 932 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAGFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 933 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPEIQRMGDRFAVEVKGRIHLDLTLVVRHTIRLPTYTLEAVYEAVFGKKKEKVYTEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 934 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRGLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 935 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQCRGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 936 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHLQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 937 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 938 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFMASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 939 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRDLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 940 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRSLKILANGYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 941 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRSLKILANGIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 942 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIITFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 943 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDCRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 944 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFDASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 945 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLMPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 946 - protein, 773 aa, synthetic construct; identical to SEQ ID NO: 193
  REGION 1..773: note = Description of Artificial Sequence: Synthetic polypeptide

SEQ ID NO: 947 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRNDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 948 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEALFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 949 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSNNPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 950 - protein, 773 aa, synthetic construct; identical to SEQ ID NO: 476
  REGION 1..773: note = Description of Artificial Sequence: Synthetic polypeptide

SEQ ID NO: 951 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAHIKKRSEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 952 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 953 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDGPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 954 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSGPSIIVTHNVSPDTLEKECKNYDVAPIVGYRFCKDFKGFIPSILEDLIETRQKVKRKMKATIDPIEKKMLDYRQRALKILANGYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 955 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 956 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYSATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 957 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEAWKAVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 958 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDAPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 959 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 960 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYGVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 961 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSGKISDRVILFDEYDSSRHKYDPDYYIHNQVLPAVLRILEAFGYKEKDLEYQRMKQTGLGAWLKMGKK

SEQ ID NO: 962 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSYPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 963 - protein, 474 aa, synthetic construct
  REGION 1..474: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPI

SEQ ID NO: 964 - protein, 773 aa, synthetic construct; identical to SEQ ID NO: 648
  REGION 1..773: note = Description of Artificial Sequence: Synthetic polypeptide

SEQ ID NO: 965 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 966 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 967 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFILSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 968 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGECHGKKVRFIRVEKVKKKFLGEPIEVWKLVFEHPQDVPAIRDAIRSHPAVCEIFEYDIPFAKRYLIDKGLVPLEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 969 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHVQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 970 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFGISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 971 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEQVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 972 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRNLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 973 - protein, 772 aa, synthetic construct
  REGION 1..772: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 974 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAASIIVTHNVSPDTLEKECRNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 975 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 976 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALNILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 977 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLFPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 978 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 979 - protein, 773 aa, synthetic construct
  REGION 1..773: note = Description of Artificial Sequence: Synthetic polypeptide
MILDTDYITENGKPVIRIFKKEKGEFKIEYDRNFEVYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 980 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLGASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 981 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGLRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 982 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFTASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 983 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQCRGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 984 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPCEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 985 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 986 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIHDAIRSHPAVREILEYDIPFAKRYLIDKGLVPVEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 987 - protein, 773 aa, synthetic construct
  REGION 1..773: note = Description of Artificial Sequence: Synthetic polypeptide
MILATDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVAVKGRIHLDLAPVVRHTIRLPTYTLEAVYEAVFGKKKEKVYAEEIAEAWKSEEGLKRVAQYSMEDARATYELGREFFPMEVELAKLIGQSVWAVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 988 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANGYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 989 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRSLKILANSIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 990 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 991 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 992 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 993 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKALANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 994 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPLDAPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 995 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFDPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 996 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYYATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 997 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQCKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 998 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRRSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 999 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEATFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1000 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1001 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1002 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVVPGTIISYVVLKGSKKISDRVILFDEYDSSRHKYDPDYYIHNQVLPAVLRILEAFGYKEKDLEYQRMKQTGLGAWLKMGKK

SEQ ID NO: 1003 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDTRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1004 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFLASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1005 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPRYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1006 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFLASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1007 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVCRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1008 - protein, 773 aa, synthetic construct; identical to SEQ ID NO: 411
  REGION 1..773: note = Description of Artificial Sequence: Synthetic polypeptide

SEQ ID NO: 1009 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1010 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSILPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1011 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHTQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1012 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKSYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1013 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKLSDRVILFDEYDSSRHKYDPDYYIHNQVLPAVLRILEAFGYKEKDLEYQRMKQTGLGAWLKMGKK

SEQ ID NO: 1014 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1015 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVTPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1016 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFIPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1017 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVLPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1018 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDTRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1019 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRALKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1020 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFNASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1021 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDTPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1022 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEGDESIEDIKKITGERLGKKVRIIRVEKVKKKFLGEPIEVRKLVFEHPQDVPAIRDAIRSHPAVREIFEYDTPFTKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1023 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDWRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1024 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRSLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1025 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSTEKAAGIVKKVVEGLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1026 - protein, 480 aa, synthetic construct
  REGION 1..480: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLD

SEQ ID NO: 1027 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIRTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1028 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1029 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFTPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1030 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKGYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1031 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1032 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1033 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSITPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1034 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDSPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1035 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRLDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1036 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPCEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1037 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRMLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1038 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1039 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANGIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1040 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGRRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1041 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPICKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1042 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKSLANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1043 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLDPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1044 - protein, 773 aa, synthetic construct
  REGION 1..773: note = Description of Artificial Sequence: Synthetic polypeptide
MILDTDYITENGKPVIRIFKKKKGEFKIEYDRNFEPYIYALLEDDESIEDIKKITGERHGKKVRIIRVEKVKKKFLGEPIEVWKQVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1045 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRSLKILANGIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1046 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLCARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1047 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIINTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1048 - protein, 773 aa, synthetic construct
  REGION 1..773: note = Description of Artificial Sequence: Synthetic polypeptide
MILDTDYITENGKPVIRIFEKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFTKRYLIDKGLVPMESGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1049 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVLASIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1050 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANFRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1051 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRGLYPGIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1052 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLMPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1053 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKENAERVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1054 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKSGKK

SEQ ID NO: 1055 - protein, 755 aa, synthetic construct
  REGION 1..755: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLE

SEQ ID NO: 1056 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEDAERVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1057 - protein, 766 aa, synthetic construct
  REGION 1..766: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGA

SEQ ID NO: 1058 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEQAEDVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1059 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRYWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1060 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRMEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1061 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAEFVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1062 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRLEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1063 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPSEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1064 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVLTSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1065 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKENAEKVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1066 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVAPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1067 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRREWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1068 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1069 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKESAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1070 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILAASYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1071 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYASIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1072 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLFTSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1073 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRTKQTGLGAWLKMGKK

SEQ ID NO: 1074 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVLPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1075 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKSLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1076 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSISPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1077 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLLPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1078 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESLTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1079 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKENAEWVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1080 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIELSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1081 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1082 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIMPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1083 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRAWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1084 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPAIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1085 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWVRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1086 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRSKQTGLGAWLKMGKK

SEQ ID NO: 1087 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRSKQTGLGAWLKMGKK

SEQ ID NO: 1088 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKRLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1089 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYTSIIVTHNVSPDTLEKECKNYDVAPIVGYRFCKDFKGFIPSILEDLIETRQKVKRKMKATIDPIEKKMLDYRQRLLKILAISYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1090 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIIKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1091 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEDAEHVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1092 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVLSSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1093 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKENAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1094 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAEDVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1095 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEKQRMKQTGLGAWLKMGKK

SEQ ID NO: 1096 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYSSIIVTHNVSPDTLEKECKNYDVAPIVGYRFCKDFKGFIPSILEDLIETRQKVKRKMKATIDPIEKKMLDYRQRLLKILAASYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1097 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLLPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1098 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAFLKMGKK

SEQ ID NO: 1099 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILATSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1100 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMSDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1101 - protein, 755 aa, synthetic construct
  REGION 1..755: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLE

SEQ ID NO: 1102 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAEEVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1103 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYTKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1104 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIFPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1105 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLSPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1106 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLFSSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1107 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAILRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1108 - protein, 758 aa, synthetic construct
  REGION 1..758: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQR

SEQ ID NO: 1109 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLEPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1110 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYVSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1111 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEDAEWVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1112 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESLTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1113 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAYLKMGKK

SEQ ID NO: 1114 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGASLKMGKK

SEQ ID NO: 1115 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKNGKK

SEQ ID NO: 1116 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYWGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1117 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSITPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1118 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEQQRMKQTGLGAWLKMGKK

SEQ ID NO: 1119 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYLKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1120 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFNIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1121 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWARHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1122 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEQAEWVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1123 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIDPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1124 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEQAEKVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1125 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIDPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1126 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYASIIVTHNVSPDTLEKECKNYDVAPIVGYRFCKDFKGFIPSILEDLIETRQKVKRKMKATIDPIEKKMLDYRQRLLKILATSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1127 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLDPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1128 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVMPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1129 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRFWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1130 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1131 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEQQRMKQTGLGAWLKMGKK

SEQ ID NO: 1132 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEHAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1133 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRRWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1134 - protein, 757 aa, synthetic construct
  REGION 1..757: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQ

SEQ ID NO: 1135 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWARHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1136 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLFASIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1137 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPNEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1138 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAINTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1139 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLARVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1140 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYRKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1141 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLMPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1142 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRNKQTGLGAWLKMGKK

SEQ ID NO: 1143 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLVPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1144 - protein, 769 aa, synthetic construct
  REGION 1..769: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLK

SEQ ID NO: 1145 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAYLKMGKK

SEQ ID NO: 1146 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVFPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1147 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEANKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1148 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1149 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWSRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1150 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVLVSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1151 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEQAEHVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1152 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRKEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1153 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWTRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1154 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRSWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1155 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPREVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1156 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYMGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1157 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLFPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1158 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1159 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANCRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1160 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYAKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1161 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKTGKK

SEQ ID NO: 1162 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMKDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1163 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRNWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1164 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKKLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1165 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVSPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1166 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRALYPAIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1167 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYTSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1168 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPNEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1169 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRFWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1170 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMNDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1171 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSILPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1172 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLFVSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1173 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1174 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESISAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1175 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVAPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1176 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESMTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1177 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFNVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1178 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1179 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1180 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRREWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1181 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKTGKK

SEQ ID NO: 1182 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRPEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1183 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILASSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1184 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKNGKK

SEQ ID NO: 1185 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESMTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1186 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEDAEFVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1187 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKENAEFVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1188 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWVRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1189 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWVRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1190 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRAWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1191 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRNKQTGLGAWLKMGKK

SEQ ID NO: 1192 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFSVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1193 - protein, 773 aa, synthetic construct; identical to SEQ ID NO: 331
  REGION 1..773: note = Description of Artificial Sequence: Synthetic polypeptide

SEQ ID NO: 1194 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILAASYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1195 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMKDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1196 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESATAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1197 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKSGKK

SEQ ID NO: 1198 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESMSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1199 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRVWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1200 - protein, 766 aa, synthetic construct
  REGION 1..766: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGA

SEQ ID NO: 1201 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIAPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1202 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKRLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1203 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRAEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1204 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWTRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1205 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1206 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVMPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1207 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKENAEHVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1208 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVEPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1209 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVEPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1210 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEDAEKVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1211 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRDEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1212 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLTNYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1213 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMNDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1214 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSITPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1215 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1216 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEDAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1217 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYVSIIVTHNVSPDTLEKECKNYDVAPIVGYRFCKDFKGFIPSILEDLIETRQKVKRKMKATIDPIEKKMLDYRQRLLKILASSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1218 - protein, 758 aa, synthetic construct
  REGION 1..758: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQR

SEQ ID NO: 1219 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLLASIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1220 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVFPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1221 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVSPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1222 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESFSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1223 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIVTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1224 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWSRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1225 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIAPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1226 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEGWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1227 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILASSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1228 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLFPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1229 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1230 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFNIVTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1231 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESITAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1232 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEQAERVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1233 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFSVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1234 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIVPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1235 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILAISYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1236 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRYWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1237 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEALFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1238 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSWYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1239 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEMAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1240 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLEPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1241 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLDPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1242 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRSEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1243 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVIAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1244 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYFGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1245 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFNINTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1246 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKNLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1247 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMRDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1248 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVDPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1249 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWTRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1250 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFNIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1251 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRNWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1252 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRRWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1253 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLLVSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1254 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESITAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1255 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFRVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1256 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYSSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1257 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPSEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1258 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVVPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1259 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPKEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1260 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKNLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1261 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPREVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1262 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIEPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1263 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSISPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1264 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRVWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1265 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAFLKMGKK

SEQ ID NO: 1266 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYRKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1267 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPKEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1268 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKKLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1269 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAHLKMGKK

SEQ ID NO: 1270 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYAKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1271 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWSRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1272 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESFTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1273 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVVPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1274 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNISPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1275 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRKWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1276 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVLPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1277 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEDAEDVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1278 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESSTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1279 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRNEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1280 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLLSSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1281 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLSPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1282 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVVAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1283 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRQWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1284 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYNGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1285 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSVIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1286 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRQWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1287 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEQAEFVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1288 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESLSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1289 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVDPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1290 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIEPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1291 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLVPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1292 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPGIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1293 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRTKQTGLGAWLKMGKK

SEQ ID NO: 1294 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILATSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1295 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRKWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1296 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIVPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1297 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKSLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1298 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEALFGKKKEKVYAEEIAEAWKSEEGLKRVAQYSMEDARATYELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1299 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILAISYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1300 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAHLKMGKK

SEQ ID NO: 1301 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLLTSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1302 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKENAEDVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1303 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWARHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1304 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYTKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1305 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIMPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1306 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEAAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1307 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRALYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1308 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIFPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1309 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRGLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1310 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGASLKMGKK

SEQ ID NO: 1311 - protein, 769 aa, synthetic construct
  REGION 1..769: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLK

SEQ ID NO: 1312 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSILPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1313 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESFTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1314 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSFYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1315 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYLKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1316 - protein, 792 aa, unidentified
  REGION 1..792: note = Description of Unknown: Euryarchaeota archaeon sequence
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVDIEVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSLYPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1317 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1318 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSSAPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1319 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYAGSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1320 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFAGSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1321 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYAPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1322 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYAGSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1323 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFAGSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1324 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1325 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1326 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYAPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1327 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSSAPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1328 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSAAASIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1329 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSAAASIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1330 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1331 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEVLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1332 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESSAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1333 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKERLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1334 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1335 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSHGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1336 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLESVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1337 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEERAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1338 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYVKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1339 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1340 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1341 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTLLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1342 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1343 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1344 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1345 - protein, 784 aa, synthetic construct
  REGION 1..784: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGIT

SEQ ID NO: 1346 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRRR

SEQ ID NO: 1347 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1348 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1349 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWEEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1350 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSIGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1351 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1352 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTRLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1353 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLERVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1354 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSYYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1355 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLRVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1356 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1357 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1358 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1359 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSVGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1360 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFARRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1361 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1362 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1363 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1364 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTRRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1365 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEKVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1366 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRRALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1367 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRGFGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1368 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1369 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLELAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1370 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKREKAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1371 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGNIIGYIITKGTKGISQRATPVEFARLEDYDPEYYIDNQILPAIQRIFEAIGYTRDYLKEGITQTSLSRWF

SEQ ID NO: 1372 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESGAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1373 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLNVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1374 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPKVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1375 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1376 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRAFGPAIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1377 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRRR

SEQ ID NO: 1378 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPNVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1379 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLATYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1380 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLDLAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1381 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1382 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSFGPGIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1383 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIFVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1384 - protein, 776 aa, synthetic construct
  REGION 1..776: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTR

SEQ ID NO: 1385 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1386 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1387 - protein, 791 aa, synthetic construct
  REGION 1..791: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRR

SEQ ID NO: 1388 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLELAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1389 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1390 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLKVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1391 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLATYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1392 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESAAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1393 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFQYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1394 - protein, 722 aa, synthetic construct
  REGION 1..722: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPG

SEQ ID NO: 1395 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRGFGPGIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1396 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLFGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1397 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIENKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1398 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1399 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPSVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1400 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHFDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1401 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSLAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1402 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYAKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1403 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1404 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFARRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1405 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1406 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLQLAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1407 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWNEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1408 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLTTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1409 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRKALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1410 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSILVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1411 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFGRMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1412 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRRALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1413 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1414 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEQKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1415 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSFAEKALKILANSFLGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1416 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYLKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1417 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1418 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSYAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1419 - protein, 791 aa, synthetic construct
  REGION 1..791: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRR

SEQ ID NO: 1420 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRNALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1421 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1422 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLFGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1423 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRAFGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1424 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1425 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLTTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1426 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFQYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1427 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSVAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1428 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIENKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1429 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSFAEKALKILANSFFGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1430 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSFGPAIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1431 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1432 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1433 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTSLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1434 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLNTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1435 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYRIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1436 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKERLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1437 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSVIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1438 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTRRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1439 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDIYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1440 - protein, 789 aa, synthetic construct
  REGION 1..789: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLS

SEQ ID NO: 1441 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1442 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1443 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRRALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1444 - protein, 722 aa, synthetic construct
  REGION 1..722: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPG

SEQ ID NO: 1445 - protein, 772 aa, synthetic construct
  REGION 1..772: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAI

SEQ ID NO: 1446 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGTIIGYIITKGTKGISQRATPVEFARLEDYDPEYYIDNQILPAIQRIFEAIGYTRDYLKEGITQTSLSRWF

SEQ ID NO: 1447 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1448 - protein, 781 aa, synthetic construct
  REGION 1..781: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKE

SEQ ID NO: 1449 - protein, 781 aa, synthetic construct; identical to SEQ ID NO: 1448
  REGION 1..781: note = Description of Artificial Sequence: Synthetic polypeptide

SEQ ID NO: 1450 - protein, 781 aa, synthetic construct
  REGION 1..781: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSLYPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKE

SEQ ID NO: 1451 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGREYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1452 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1453 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1454 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1455 - protein, 792 aa, synthetic construct
  REGION 1..792: note = Description of Artificial Sequence: Synthetic polypeptide
MPRILKGFLIDADIETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1456 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1457 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1458 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1459 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1460 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1461 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVRQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1462 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLKGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1463 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1464 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1465 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKVLKILANNFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1466 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1467 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1468 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSSAGSIIVSHNIDPSTLIVGNCEENRAPELEYCFSLEREGFIPAILKELIRRRAEIKRELKRSEGDRRRTLSFAEKLLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1469 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLLGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1470 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1471 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1472 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVDRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1473 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1474 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1475 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1476 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1477 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1478 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1479 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSSAGSIIVSHNIDPSTLIVGNCEENRAPELEYCFSLEREGFIPAILKELIRRRAEIKRELKRSEGDRRRTLSFAEKSLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1480 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSLYPSIIVSHNIDPSTLIVGNCEENRAPELEYCFSLEREGFIPAILKELIRRRAEIKRELKRSEGDRRRTLSFAEKLLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1481 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1482 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1483 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSVYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1484 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1485 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRGECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1486 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1487 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1488 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1489 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1490 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1491 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1492 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1493 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVDIEVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSAAASIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1494 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1495 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1496 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1497 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1498 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1499 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKRYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1500 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1501 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1502 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKSLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1503 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1504 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1505 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1506 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1507 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1508 - protein, 792 aa, synthetic construct; identical to SEQ ID NO: 1325
  REGION 1..792: note = Description of Artificial Sequence: Synthetic polypeptide

SEQ ID NO: 1509 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1510 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSSYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1511 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1512 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1513 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKVLKILANSIYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1514 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1515 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDAPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1516 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1517 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1518 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1519 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1520 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1521 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1522 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

(The sequence listing continues in the following parts.)

The invention claimed is:

1. A method for pairwise sequencing, comprising:
   a) providing a plurality of immobilized nucleic acid concatemer template molecules each comprising at least one uridine that can be enzymatically cleaved to generate an abasic site in the concatemer template molecule, wherein individual concatemer template molecules in the plurality are immobilized to a first surface primer that is immobilized to a support;
   b) sequencing the plurality of immobilized concatemer template molecules with a plurality of soluble forward sequencing primers a plurality of sequencing polymerases, a plurality of multivalent molecules and a plurality of nucleotide analogs, thereby generating a plurality of extended forward sequencing primer strands, wherein individual immobilized concatemer template molecules have two or more extended forward sequencing primer strands hybridized thereon;
   c) retaining the plurality of immobilized concatemer template molecules and replacing the plurality of extended forward sequencing primer strands with a plurality of forward extension strands that are hybridized to the retained immobilized single stranded nucleic acid concatemer template molecules by conducting a primer extension reaction;
   d) removing the retained immobilized concatemer template molecules by generating abasic sites at the at least one uridine in the immobilized concatemer template molecules and generating gaps at the abasic sites to generate a plurality of gap-containing concatemer template molecules while retaining the plurality of forward extension strands and retaining the plurality of immobilized surface primers; and
   e) sequencing the plurality of retained forward extension strands with a plurality of soluble reverse sequencing primers a plurality of sequencing polymerases, a plurality of multivalent molecules and a plurality of nucleotide analogs, thereby generating a plurality of extended reverse sequencing primer strands, wherein individual retained forward extension strands have two or more extended reverse sequencing primer strands hybridized thereon,
   wherein individual multivalent molecules of the plurality of multivalent molecules of steps (b) and (e) comprise (1) a core; and (2) a plurality of nucleotide arms which comprise (i) a core attachment moiety, (ii) a spacer, (iii) a linker, and (iv) a nucleotide unit, wherein the core is attached to the plurality of nucleotide arms via their core attachment moiety, and wherein the spacer is attached to the linker, and wherein the linker is attached to the nucleotide unit.

2. The method of claim 1, wherein the plurality of sequencing polymerases of steps (b) and (e) comprises an amino acid sequence having at least 95% sequence identity to SEQ ID NO: 1316 and comprising amino acid substitutions aspartic acid at position 168 substituted with alanine (D168A) and glutamic acid at position 170 substituted with alanine (E170A).

3. The method of claim 1, wherein individual concatemer template molecules in the plurality are covalently joined to an immobilized first surface primer.

4. The method of claim 1, wherein individual concatemer template molecules in the plurality are hybridized to an immobilized first surface primer.

5. The method of claim 1, wherein each nucleotide analog in the plurality of nucleotide analogs of steps (b) and (e) comprise a removable chain terminating moiety at the 3' sugar group, wherein the removable chain terminating moiety comprises an alkyl group, alkenyl group, alkynyl group, allyl group, aryl group, benzyl group, azide group, azido group, O-azidomethyl group, amine group, amide group, keto group, isocyanate group, phosphate group, thio group, disulfide group, carbonate group, urea group, or silyl group, and wherein the removable chain terminating moiety is cleavable with a chemical compound to generate an extendible 3' OH moiety on the sugar group.

6. The method of claim 1, wherein the plurality of nucleotide analogs of steps (b) and (e) comprises one type of nucleotide selected from the group consisting of dATP, dGTP, dCTP, dTTP, and dUTP.

7. The method of claim 1, wherein the plurality of nucleotide analogs of steps (b) and (C) comprises a mixture of any combination of two or more types of nucleotides selected from the group consisting of dATP, dGTP, dCTP, dTTP and dUTP.

8. The method of claim 1, wherein the plurality of nucleotide analogs of steps (b) and (e) comprises a plurality of non-labeled nucleotide analogs.

9. The method of claim 1, wherein the plurality of nucleotide analogs of steps (b) and (e) comprises a plurality of at least one non-labeled nucleotide analog.

10. The method of claim 1, wherein the plurality of nucleotide analogs of steps (b) and (e) comprises a plurality of fluorophore-labeled nucleotide analogs.

11. The method of claim 1, wherein the plurality of nucleotide analogs of step (b) and (e) comprises 3-10 phosphate groups.

12. A method for pairwise sequencing, comprising:
    a) providing a plurality of immobilized nucleic acid concatemer template molecules each comprising at least one uridine that can be enzymatically cleaved to generate an abasic site in the concatemer template molecule, wherein individual concatemer template molecules in the plurality are immobilized to a first surface primer that is immobilized to a support;
    b) sequencing the plurality of immobilized concatemer template molecules with a plurality of soluble forward sequencing primers, a plurality of sequencing polymerases and a plurality of multivalent molecules and generating a plurality of extended forward sequencing primer strands, wherein individual immobilized concatemer template molecules have two or more extended forward sequencing primer strands hybridized thereon;
    c) retaining the plurality of immobilized concatemer template molecules and replacing the plurality of extended forward sequencing primer strands with a plurality of forward extension strands that are hybridized to the retained immobilized single stranded nucleic acid concatemer template molecules by conducting a primer extension reaction;
    d) removing the retained immobilized concatemer template molecules by generating abasic sites at the at least one uridine in the immobilized concatemer template molecules and generating gaps at the abasic sites to generate a plurality of gap-containing concatemer template molecules while retaining the plurality of forward extension strands and retaining the plurality of immobilized surface primers; and
    e) sequencing the plurality of retained forward extension strands with a plurality of soluble reverse sequencing primers, a plurality of sequencing polymerases and a plurality of multivalent molecules, thereby generating a plurality of extended reverse sequencing primer strands, wherein individual retained forward extension strands have two or more extended reverse sequencing primer strands hybridized thereon,
wherein individual multivalent molecules of the plurality of multivalent molecules of steps (b) and (e) comprise (1) a core; and (2) a plurality of nucleotide arms which comprise (i) a core attachment moiety, (ii) a spacer, (iii) a linker, and (iv) a nucleotide unit, wherein the core is attached to the plurality of nucleotide arms via their core attachment moiety, and
wherein the spacer is attached to the linker, and wherein the linker is attached to the nucleotide unit.

13. The method of claim 12, wherein the plurality of sequencing polymerases of steps (b) and (e) comprises an amino acid sequence having at least 95% sequence identity to SEQ ID NO: 1 and comprising amino acid substitutions aspartic acid at position 141 substituted with alanine (D141A) and glutamic acid at position 143 substituted with alanine (E143A).

14. The method of claim 12, wherein individual concatemer template molecules in the plurality are covalently joined to an immobilized first surface primer.

15. The method of claim 12, wherein individual concatemer template molecules in the plurality are hybridized to an immobilized first surface primer.

16. The method of claim 12, wherein the nucleotide unit of individual multivalent molecules in the plurality of steps (b) and (e) comprises an aromatic base, a five carbon sugar and 1-1.0 phosphate groups.

17. The method of claim 12, wherein the core of individual multivalent molecules in the plurality of steps (b) and (e) comprises streptavidin.

18. The method of claim 12, wherein the core attachment moiety of individual multivalent molecules in the plurality of steps (b) and (e) comprises biotin.

19. The method of claim 12, wherein the linker of individual multivalent molecules in the plurality of steps (b) and (e) comprises an aliphatic chain having 2-6 subunits of an oligo ethylene glycol chain having 2-6 subunits.

20. The method of claim 12, wherein the plurality of nucleotide arms attached to the core of the multivalent molecules of steps (b) and (e) has the same type of a nucleotide unit, and wherein the type of nucleotide unit is selected from the group consisting of dATP, dGTP, dCTP, dTTP and dUTP.

21. The method of claim 12, wherein the plurality of multivalent molecules of step (h) and (e) comprises one type of a multivalent molecule, wherein each multivalent molecule in the plurality has the same type of nucleotide unit selected from the group consisting of dATP, dGTP, dCTP, dTTP and dUTP.

22. The method of claim 12, wherein the plurality of multivalent molecules of step (b) and (e) comprises a mixture of any combination of two or more types of multivalent molecules, each type having nucleotide units selected from the group consisting of dATP, dGTP, dCTP, dTTP and dUTP.

23. The method of claim 12, wherein the plurality of multivalent molecules of step (b) and (e) comprises fluorophore-labeled multivalent molecules.

24. The method of claim 12, wherein the plurality of sequencing polymerases in steps (b) and (e) binds a concatemer template molecule, a soluble sequencing primer and a multivalent molecule to form a binding complex which exhibits a persistence time of greater than 0.5 seconds, wherein the nucleic acid template molecule comprises an immobilized concatemer template molecule or a retained forward extension strand, and wherein the soluble sequencing primer comprises a soluble forward sequencing primer or a soluble reverse sequencing primer.

25. The method of claim 12, further comprising: forming at least one avidity complex in the sequencing of step (b), the method comprising:
   a) binding a first soluble forward sequencing primer, a first sequencing polymerase, and a first multivalent molecule to a first portion of a first concatemer template molecule thereby forming a first binding complex, wherein a first nucleotide unit of the first multivalent molecule binds to the first sequencing polymerase; and
   b) binding a second forward sequencing primer, a second sequencing polymerase, and the first multivalent molecule to a second portion of the same first concatemer template molecule thereby forming a second binding complex, wherein a second nucleotide unit of a second multivalent molecule binds to the second sequencing polymerase, and wherein the first and second binding complexes which include the same multivalent molecule forms an avidity complex.

* * * * *